United States Patent 11,098,302 (IDENTIFICATION OF POLYNUCLEOTIDES ASSOCIATED WITH A SAMPLE) - sequence listing, part 113

SEQ ID NO: 389905 - DNA, 548 bp, Homo sapiens
  misc_feature: GZ8MTXP02HDMEB.13.59.F04.1.454.CMB.2.raw
  modified_base (203)..(203): a, c, t, g, unknown or other
  modified_base (229)..(229): a, c, t, g, unknown or other
  modified_base (451)..(451): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagagtcaccgtcacttggccgggnagtcacgacattaacacttattagcctggtatcagcagaagccagggagagtaccctaaattatgatctctgctgcgtccgcctgcaacgtcggggtccatcgtcgttcagtgggcggtggatcgtaggacagtaattcactctcacatcacccactcgacaccctagaagtatggttagtagtttattactgtacagtacctagtagtggtcggacccgtntcgtaacggtttccgggacgggtacgggaaccgtaagggtcgacgtaaggaactaacgaaaaccgtaaacgtcggtacggacgttcggacctaaccg

SEQ ID NO: 389906 - DNA, 541 bp, Homo sapiens
  misc_feature: GZ8MTXP02FJLZK.13.59.F04.1.454.CMB.2.raw
  modified_base (215)..(215): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttggccgggnagtcacgacattaacacttatttagcctggtatcagcagaagccagggagagtaccctaaattattgatctctgctgcgtccgcttgcaacgtcggggtccagtctcgtcagtggcggtgatcgtagacagattcactctcacatccaccacctgccaccctagaacgtatggttaggtaacgtttatttactagtacacgtaccttagtacggtggtcggcccgtctacgttacgttttacggggcgggtaacgggaccgaaacgggtgacgaggaactaacgaaaacgtaacgtggtcggctcggacaaccg

SEQ ID NO: 389907 - DNA, 520 bp, Homo sapiens
  misc_feature: GZ8MTXP02HX15C.13.59.F04.1.454.CMB.2.raw
  modified_base (226)..(226): a, c, t, g, unknown or other
  modified_base (402)..(402): a, c, t, g, unknown or other
  modified_base (460)..(460): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacataaacacttattagcctggtatcagcaagaagccgagggagagtaccctaaaattattagatctctgctgcgtccgtcttgcaacgtccggggtacccagtctcggttcaggttggcgggtgatcgtaagacaagtaaattcaactctcacataccaccaaacctnaccaaccctgaaagattaggttaggaatttatactgtacagactagtagtggcgccgntctgtttcggcggacggacaaagggcacagactaacgaacgacgtacgagacgacgacac

SEQ ID NO: 389908 - DNA, 524 bp, Homo sapiens
  misc_feature: GZ8MTXP02I40JU.13.59.F04.1.454.CMB.2.raw
  modified_base (201)..(201): a, c, t, g, unknown or other
  modified_base (215)..(215): a, c, t, g, unknown or other
  modified_base (227)..(227): a, c, t, g, unknown or other
  modified_base (278)..(278): a, c, t, g, unknown or other
  modified_base (452)..(452): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttcgccgggngagtcacgacattaacacttattagcctggtatcagcagaagccgaggganagtaccctaaattattgatctctgctgcgtccgccttgacaacgtccggggtccatcgtcgtcagtgggcgtggatcgtagacagaactcactctcacataccacacctgccaccgtagaacgtagtgttagaaagtttattactgtacacgtactagtagtggtcgacccgtntctagtttcgggacggtacggaccgaaggtcgacgaggataacgaaacgtaacgtggtacgctacgactaac

SEQ ID NO: 389909 - DNA, 571 bp, Homo sapiens
  misc_feature: GZ8MTXP02JRQMW.13.59.F04.1.454.CMB.2.raw
  modified_base (227)..(227): a, c, t, g, unknown or other
  modified_base (293)..(293): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggngacgtcacgacattaacacttattagcctggtatcagcagaagccagggagacgtaccctaaattnttgattctctgctgcgtccgcttgcacgtcggggccatctcggttcagtggcggtgatctagacagtaatcactctcacataccaccaacctcgaccaccctgaacgtagttagttaggtaagttatttacttacgtactaagtaccgttaagtacgtgggttcggtcccgtcgtcgttaacggtttttccgggacgggtaacggggaacccgtaaagggtcgtaccgaaggaacttaacgaaaacgaaccgtaggttacggcttacggactaacccg

SEQ ID NO: 389910 - DNA, 531 bp, Homo sapiens
  misc_feature: GZ8MTXP02H8NAJ.13.59.F04.1.454.CMB.2.raw
  modified_base (356)..(356): a, c, t, g, unknown or other
  modified_base (388)..(388): a, c, t, g, unknown or other
  modified_base (407)..(407): a, c, t, g, unknown or other
  modified_base (450)..(450): a, c, t, g, unknown or other
  modified_base (481)..(481): a, c, t, g, unknown or other
tcagtcacgtactacacgaccggtgctcgatttagtacacacacttagggattgggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggagccctggagtggctgcagcattgattgggatgatgatacaaaatntacaacacatctatgaagaccagctcacatcnccaagacatcttacacganccaaagtgtaccttaagatgaactaacttggaccctgtgacanaggcactattatgtagctacatacaaaaggnactttacacgtaacggtgtacggtacgtgtcggggaccaagggggtcccg

SEQ ID NO: 389911 - DNA, 513 bp, Homo sapiens
  misc_feature: GZ8MTXP02H5EOO.13.59.F04.1.454.CMB.2.raw
  modified_base (343)..(343): a, c, t, g, unknown or other
  modified_base (433)..(433): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgctccgcttgcaatccggggtccatctcgttcacgtggcgtggntctagacagaattcatctcaccatccaaccaacctgacaccctgaagatgttaggaagtttatactgtcagacctatagtcggtgcccgntctacttttcggcggacgggtaccaaaggtcgacgagacttaacgaaaaccggtaaactcggtgggcttcggactaaccg

SEQ ID NO: 389912 - DNA, 555 bp, Homo sapiens
  misc_feature: GZ8MTXP02GRYLN.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggngagtcacgacattaacacttatttagcctggtatcagcagagccagggagagtccctaaattattgatctctgctgcgtccgccttgcaacgtcggggtccagtctcggttcgagtgggcggtggactcgtaggacagtaacttcactcctacaccatccaaccaacctcgaccaaccctagaagtagtagttaggaagtttattacgtgtacacgtacctagtagtggttcggccgtcgtctacgtttcggacggaacgggtaccgaaagggtcgcgaagacgtaacgaaaaccgtaacgtttacgggtacgtacgtacgacctacg

SEQ ID NO: 389913 - DNA, 562 bp, Homo sapiens
  misc_feature: GZ8MTXP02HKNDY.13.59.F04.1.454.CMB.2.raw
  modified_base (200)..(200): a, c, t, g, unknown or other
  modified_base (225)..(225): a, c, t, g, unknown or other
  modified_base (264)..(264): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtcacttgccgggnagtcacgacattaacattattagcctggtatcagcaganccgaggagagtccctaaattattgaatctctgctgcgtccgtcctgcaacgttccggggtccctagtcgtcggttcaggtgggtcggtggactcgtaggacagtaatcactctcaccatccaccaacctcgccacccttagaacgtattggttaggaagtttacttactggttacacgtacctagttaacggtcgggtacggtcccgtgttccgtacggttttccgggacgggtacgggacccgtaaagggtcgaccgaagacgtaacgaaaacgtacgtagtcggcacgactaaccg

SEQ ID NO: 389914 - DNA, 499 bp, Homo sapiens
  misc_feature: GZ8MTXP02ISGWW.13.59.F04.1.454.CMB.2.raw
  modified_base (215)..(215): a, c, t, g, unknown or other
  modified_base (391)..(391): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcacgacattaacacttattagcctggtatcagcagaagccagggagagtccctaaattattgatctctgctgcgtccgccttgcaatccggggtccatctcgttccagtgggcgtggagtctaggacagaatcactctcacatcaccaacctgcaccctganatgttgaagttattactgtacagtacctagtagtgtggcccgctctatttcgggcggacgggaccgaaggtgacagataacgaaacgacgtacgtggctcggacaacc

SEQ ID NO: 389915 - DNA, 477 bp, Homo sapiens
  misc_feature: GZ8MTXP02FGRG7.13.59.F04.1.454.CMB.2.raw
  modified_base (215)..(215): a, c, t, g, unknown or other
  modified_base (407)..(407): a, c, t, g, unknown or other
  modified_base (414)..(414): a, c, t, g, unknown or other
  modified_base (419)..(419): a, c, t, g, unknown or other
  modified_base (469)..(469): a, c, t, g, unknown or other
  modified_base (474)..(474): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagtcagacattaacactatttagcctggtatcagcagaagccagggagagtccctaaattattgatctctgctgcgtccgcttgcaactcggggtccatctcggttcagtggcgtggatctaggacagaaattcactctcacatcaccaactgcacctgaagatgtgaagttattactgtnagactanagtgngccgctcatttcgcggaggaccaaggtgacagaaacaacgaacgacgtgngcgcncac

SEQ ID NO: 389916 - DNA, 526 bp, Homo sapiens
  misc_feature: GZ8MTXP02FXV7B.13.59.F04.1.454.CMB.2.raw
  modified_base (226)..(226): a, c, t, g, unknown or other
  modified_base (362)..(362): a, c, t, g, unknown or other
  modified_base (369)..(369): a, c, t, g, unknown or other
  modified_base (378)..(378): a, c, t, g, unknown or other
  modified_base (387)..(387): a, c, t, g, unknown or other
  modified_base (390)..(390): a, c, t, g, unknown or other
  modified_base (397)..(397): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtaccctaaattattgatctctgctgtcgtccgccttgcaacgtccggggtcccatcgtcgttcagtgggcgtggatcgtagganagaattnactctcacntcaccactnacncccaganagtgtaggtaagttattactgtacacgtacctataggttggtgcccgtcttactagttttccgggcggtacgggaccgtaagggtcgaccgagaactaacgaaacgaacgtacggtgctcggactaccg

SEQ ID NO: 389917 - DNA, 567 bp, Homo sapiens
  misc_feature: GZ8MTXP02IHI7G.13.59.F04.1.454.CMB.2.raw
  modified_base (308)..(308): a, c, t, g, unknown or other
  modified_base (390)..(390): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggcgagtcacgacattaaactacttattagcctggtatcagcgaagaagaccgagggagacgtaccctaaattatagtatctntgctgcgtccgtccttgacgacgtccggggtccagtcgttcggttgagtggcggtgatcgtagacagtatcactctacacanacccaccaacctcgcccacccgtagaacgagttggttagtaagtttatacttagtacacgtaccgtagttacggtggtcggcccgtctacgttacgtttcggaccgggtaaggacccgtaagggtcgacgaagaagtaaccgaaaacgtaacgtggtacggtactacggtaccaccg

SEQ ID NO: 389918 - DNA, 503 bp, Homo sapiens
  misc_feature: GZ8MTXP02F7KXH.13.59.F04.1.454.CMB.2.raw
  modified_base (367)..(367): a, c, t, g, unknown or other
  modified_base (375)..(375): a, c, t, g, unknown or other
  modified_base (384)..(384): a, c, t, g, unknown or other
  modified_base (402)..(402): a, c, t, g, unknown or other
  modified_base (415)..(415): a, c, t, g, unknown or other
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagagccagggagagtccctaaattattgatctctgctgcgtccgccttgcaacgtcggggcccatctcgtcagtggcggtgatctagacagattcactctcacntcacaccngcacctganatgtgtagttatatgtanacgtactattagnggtcgcccgctcgtacgtttccggnggacgggtaccaaagggttcgacgagtacgtaacgaaaacgaacgtgttggctacgctaaccg

SEQ ID NO: 389919 - DNA, 431 bp, Homo sapiens
  misc_feature: GZ8MTXP02FL12N.13.59.F04.1.454.CMB.2.raw
  modified_base (325)..(325): a, c, t, g, unknown or other
  modified_base (425)..(431): a, c, t, g, unknown or other
tcagtcacgtactacacgaccggtgctcgatttagtacacacacttagggattggggaaatctatcatagtgggaccacctactacagcccgtccctcaatagtcgcgtcaccatgtcagtggacgagcccaagaaccagttctccctgagcctgacctctgtaaccgccgcggactcggccctatacttctgtgcgagagatcgagatgtgtcatcgcggggcacttttgatatctggggccaagggtcgatggtcatcgtctcttcagcctccaccaacgggcccatccggtccttcccccgtggccgccctgcctccaggcnccacctccgagacgcacaggccgccgtgggctcgccgtggtacaacggtactacttccgtagtaccgtgacgtgagcggggctggacgaggcgacatagnnnnnnn

SEQ ID NO: 389920 - DNA, 561 bp, Homo sapiens
  misc_feature: GZ8MTXP02HNP2U.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctccgaggtgccagatgtgacatccagatgagccagtctccatccaccctgtctgcgtctctcggagacagggtcaccatcacttgtcgggcaagtcagaacattggcaactcttaaatggtatcagcagagtcagggcaacgcccccgaactcctagactctaacggtacactcctactttgaccacgtaggtcgggactccccatacgaaggttccagtcggctagtagatacgtaggaacagtacttttacccacaccatcgaggggtctacgagcctagaagtatttgacgtactttacgtattcgtacaactagtacgtttacccttccgtccccggtacgttccggaccgtaacgggaccgtaagggtaggaaactacgaacgaccgaacgtgtacgcgtcgacactactctcgtctttac

SEQ ID NO: 389921 - DNA, 656 bp, Homo sapiens
  misc_feature: GZ8MTXP02HOYMX.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttggagacagagtccaccgtcacgttcggccgggcgagtcacgacattaaacacttattagcctggtatcagcagaagccgagggagacgtaccctaaattattagtatctctgtctgtccgtccgtccttgacctaacggtccgggggtacctacgttcgttcggttccgaggtcggggtcgggtggtagtccgtaggacgagtaatctactcctcaaccactccaacccaacctcgaccctacccgtagaacgtagttaggtttaggtaaaggttttacttacttcgtaacgtacgtaaccttagttaacgggtcggtccgggtcccgtacgttcgttacggtttaccggggtaccggggtaacgggtaaacccggtaagggttacggacgtaaacgtaacgttaaaccgaaaacccggtaaacgttagggttcggaccgtacggtacctaaacccg

SEQ ID NO: 389922 - DNA, 572 bp, Homo sapiens
  misc_feature: GZ8MTXP02J2LE5.13.59.F04.1.454.CMB.2.raw
  modified_base (201)..(201): a, c, t, g, unknown or other
  modified_base (276)..(276): a, c, t, g, unknown or other
  modified_base (339)..(339): a, c, t, g, unknown or other
  modified_base (392)..(392): a, c, t, g, unknown or other
  modified_base (396)..(396): a, c, t, g, unknown or other
  modified_base (410)..(410): a, c, t, g, unknown or other
  modified_base (445)..(445): a, c, t, g, unknown or other
  modified_base (480)..(480): a, c, t, g, unknown or other
tcagtcacgtactacacgaccggtgctcgattagtacacacacttagggattgggggcagaagtctctctcagtcaggacacagcatggacatgagggtccctgctcagctcctgggactcctgctgctctggctcccagataccagatgtgacatccagatcgacccagtcctccatcctcctgtctgcatctcttgganacagagtccaccgtcacttggccggcgagtcacgtacatacacttattagcctggtatcagccagacgccagggnagtaccctaaatcttgatctctgtctggccgtccgtcccttagccgaacgtccgggggtcccnctacgttcggttctaggtgggtcgggttggctctaggcagaattcactctacnccanaccacacctgaccnccctagaagtatagtttacggaatttagtttaacnggttcacgtacctaagtggtcggtcggtccccgtnttaccgttacgttttccgggacgggacgggtaaaccgaaggttcggacaacgacgttaaccaaacgaacttggtacggccttgacctaaccc

SEQ ID NO: 389923 - DNA, 541 bp, Homo sapiens
  misc_feature: GZ8MTXP02HCTRT.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggnagtcacgacattaacacttattagcctggtatcagcagaagccgagggagagtacccgtaaattattgatctctgctgcgtccgtccttgcaacgtcggggtcccagtcgtcggttcagtggcggtggatcgaggacagtaattcgactctcacataccacctaacctgaccaccctagaacgatgttaggaagtttattactgtacagtacctagtagtggtcggccgtctcgtacgtttcgggacgggtacgggtaccgaagggtcgacgtagactaacgaaacgtaacgtgtacggcgttacgactaaccg

SEQ ID NO: 389924 - DNA, 571 bp, Homo sapiens
  misc_feature: GZ8MTXP02IQJ5R.13.59.F04.1.454.CMB.2.raw
  modified_base (260)..(260): a, c, t, g, unknown or other
  modified_base (358)..(358): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatnagcagaagccagggagagtaccctaaattatgatctctgctgccgtccgtccttgctaacgtccggggtcccagtcttccggttcagtgggtcgtggntcgtaggacagtaatcactctacaccatctaccaacctgaccaccctagaacgtagtacgttaggtaacgtttattaccttggtccaagtacccgtagttaggtcggtcggtcccgctcgtacgtttcggacgggtacggggtaaccaagggtcgacgaacgtaacgttaaccgaaaacggtaaccgttggtcgggtactcggacctaacccg

SEQ ID NO: 389925 - DNA, 563 bp, Homo sapiens
  misc_feature: GZ8MTXP02JNF9F.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattacacttattagcctggtatcagcagaagccagggagagtccctaaattattgatctctgctgcgtccgccttgcaacgtcggggtcccatctcggttcacgtggcggtggatctagacagaattcatctcacatcaaccacctgccaccctgaacgatggtagtaaggtttattaacctggtactacgacctagtaagtcgggtcggcccggctcgtaagtttttccgggcgggtaacgggacccgtaaaaggggttcgtaccgtaacgaacgttaaccgtaaaacggaaaaccgtggttaacggacgttccggacgtaaccccg

SEQ ID NO: 389926 - DNA, 486 bp, Homo sapiens
  misc_feature: GZ8MTXP02IOKKY.13.59.F04.1.454.CMB.2.raw
  modified_base (201)..(201): a, c, t, g, unknown or other
  modified_base (226)..(226): a, c, t, g, unknown or other
  modified_base (278)..(278): a, c, t, g, unknown or other
  modified_base (302)..(302): a, c, t, g, unknown or other
  modified_base (411)..(411): a, c, t, g, unknown or other
  modified_base (414)..(414): a, c, t, g, unknown or other
  modified_base (465)..(465): a, c, t, g, unknown or other
  modified_base (478)..(478): a, c, t, g, unknown or other
  modified_base (481)..(481): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggngagtcaacgacattaacacttattagcctggtatcagcagaagccagggganacgtacctaaattatcatctcgtnctcgcgtctctgacgtaccgtcggtctcgtcgtcgtcgtgtggtgtgagtagtagagatactactactctacacacacaccacacacacagagatagtagtattatatntanagactagtagtgtcgcgtctctacgtcggaggacgacgacgacgacgaganaagaacacgacgngcncacac

SEQ ID NO: 389927 - DNA, 511 bp, Homo sapiens
  misc_feature: GZ8MTXP02GMDCR.13.59.F04.1.454.CMB.2.raw
  modified_base (225)..(225): a, c, t, g, unknown or other
  modified_base (294)..(294): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggnagtcagacattaacacttattagcctggtatcagcagaagccagggagagtaccctaaatattgatctntgctgcgtccgcttgcaacgtcggggtccatctcgtcagtggcgtgatctagacagaattcactctcactatcaccaacctgccacctgaagatgtaggaattatactgtcagactatagtgtcgccgtctcgtacgtttcgggacggtacgggacctaaagggtcgacgagtaactaacgaaaacgaaaccgtgttcggtaccgtacgactaaccg

SEQ ID NO: 389928 - DNA, 521 bp, Homo sapiens
  misc_feature: GZ8MTXP02JKXTE.13.59.F04.1.454.CMB.2.raw
  modified_base (201)..(201): a, c, t, g, unknown or other
  modified_base (302)..(302): a, c, t, g, unknown or other
  modified_base (346)..(346): a, c, t, g, unknown or other
  modified_base (388)..(388): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctcctgtctgcatctcttgganacagagtcaccgtcacgttgccgggcagtcacgacattaacacttattagcctggtatcagacagaagccgagggagacgtaccctaaagttattgatctntgctgcgtccgccttgcgaaccgtcggggtccatcgtcgttcgnggtggcggtgatgtagacatactcactcacacacacaccacncgaccaccgtagaacgtagtagttagtagttactactagtacagtactagtgtcggtcgccgtcgtacgttcggttacggacggacggacgtacgacgacgagactaacgaaacgacgtcgcgcgtacgacac

SEQ ID NO: 389929 - DNA, 568 bp, Homo sapiens
  misc_feature: GZ8MTXP02GWUR8.13.59.F04.1.454.CMB.2.raw
  modified_base (203)..(203): a, c, t, g, unknown or other
  modified_base (229)..(229): a, c, t, g, unknown or other
  modified_base (414)..(414): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcattctcttgganacagagtcaccgtcacttggccgggnagtcacgacattaacacttattagctggtatcagcagagccgagggagagtaccctaaattatagatctctgctgcgtccgctgctacgtccggggtcctagtctcggttcaggtggggtcggtggtacgtcgtaggacaagtaattcactcctacaccatccaccaacctgaccaccctagaanagttgttagtaacgtttattacgtgtacagtactagttagtcggtcggtcccgtcgttacgtcgtttacggggacgggacgggtaaaccgtagggtacgaccgtagtaacgttaaccgaaaacggtaccgtaggtaggctacggacctaacccg

SEQ ID NO: 389930 - DNA, 518 bp, Homo sapiens
  misc_feature: GZ8MTXP02GYV4W.13.59.F04.1.454.CMB.2.raw
  modified_base (201)..(201): a, c, t, g, unknown or other
  modified_base (225)..(225): a, c, t, g, unknown or other
  modified_base (512)..(512): a, c, t, g, unknown or other
  modified_base (517)..(517): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcacgtcacttgccgggnagtcacgacattaacacttattagcctggtatcagcagaagccgaggagagtccctaaattattgatctactgctgcgtccgtcctgcaacgtcggggtccatcgtcggttcagtgggcggtggactcgtagggacagtaatcactctcacatacacccacctgccaccctagaagtatggttaggtaactttagttactgttacagtacctagtagttggcgccggtactcgtattttcggcggacggaccgaaggtcgacagataacgaacgaacgtgcggtacncgacnc

SEQ ID NO: 389931 - DNA, 572 bp, Homo sapiens
  misc_feature: GZ8MTXP02F6HO0.13.59.F04.1.454.CMB.2.raw
  modified_base (203)..(203): a, c, t, g, unknown or other
  modified_base (229)..(229): a, c, t, g, unknown or other
  modified_base (278)..(278): a, c, t, g, unknown or other
  modified_base (301)..(301): a, c, t, g, unknown or other
  modified_base (353)..(353): a, c, t, g, unknown or other
  modified_base (381)..(381): a, c, t, g, unknown or other
  modified_base (401)..(401): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgctatctcttgganacagagtcaccgtcacgttggccggnagtcacgacattaacacttattagcctggtatcagcagaagccaggganacgtacctaaattattgattctntgctgcgtccgcttgcgaacgtcggggtcccatcgttcggtcagtgggcggnggtatcgtaggacagtatcactctcacntacaccgactgccaccaganagtgttaggtaatttatacgtagtacaacgtaccttagtaggttcggtcgacccgtcttcgtaacggttttccggggacgggttaacgggaaaccggttaaagggtcgaaccgagtaaacgttaaaccgaaaaccgtaagtacgggttacggaccttacggacctaaaccg

SEQ ID NO: 389932 - DNA, 516 bp, Homo sapiens
  misc_feature: GZ8MTXP02IP06N.13.59.F04.1.454.CMB.2.raw
  modified_base (433)..(433): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcagtcacgacattaacacttattagcctggtatcagcagagccagggagagtaccctaaattacttgatctctgctgcgtccgccttgcaacgtccggggtccagtcgtcgttcagtgggcgtggatctaggacagaatcactctcacatcacacctgcacctgacatgttagaagtttatactgtcagtactataggtgtcgccgntcgtacgtttcgggcggacggggtaaaccagggtcgacgaggtactaacgaaaacgtaccttaggtcgcttacggacaacccg

SEQ ID NO: 389933 - DNA, 619 bp, Homo sapiens
  misc_feature: GZ8MTXP02IGNSO.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtccctaaatatgatctctgctgcgtccgcttgcaacgtccggggtcccatctcggttcagtggcgtggatcgtagacagtatcactctcaccatccaccaaacctgaccacccctagaaagagttgttaggtaaagttttattaccttaggtacctaggtaacccttaagtaacggttcggggtacggtcccccggtctaccgttacgtttttacccgggggaccggggttaacggggaaccccggtaaaggggttacggaacccgtaaagggaactttaaccgaaaaaccggtaaaacccgttggtacggggtaaccttcgggaacccttaaaccccgg

SEQ ID NO: 389934 - DNA, 499 bp, Homo sapiens
  misc_feature: GZ8MTXP02FPBRT.13.59.F04.1.454.CMB.2.raw
  modified_base (226)..(226): a, c, t, g, unknown or other
  modified_base (436)..(436): a, c, t, g, unknown or other
  modified_base (448)..(448): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttatttagcctggtatcagcagaagccagggagagtccctaaattattgatctctgctgcgtccgcttgcaactcggggtccatctcggttcagtggcggtggatctaggacagaattcactctcaccatcaccaacctgcaccctgaagatgttggaagttattactgtacagacctatagtggtcgccgntctactttcggnggtacgggaccaaaggtcgcagataacgaaaacgaactgtaggctgcaacc

SEQ ID NO: 389935 - DNA, 517 bp, Homo sapiens
  misc_feature: GZ8MTXP02G38ZX.13.59.F04.1.454.CMB.2.raw
  modified_base (201)..(201): a, c, t, g, unknown or other
  modified_base (225)..(225): a, c, t, g, unknown or other
  modified_base (273)..(273): a, c, t, g, unknown or other
  modified_base (293)..(293): a, c, t, g, unknown or other
  modified_base (451)..(451): a, c, t, g, unknown or other
  modified_base (491)..(491): a, c, t, g, unknown or other
  modified_base (511)..(511): a, c, t, g, unknown or other
  modified_base (516)..(516): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctcctgtctgcatctctgganacagagtcacgtcacttgccgggnagtcacgacattaacacttattagcctggtatcagcagagccaggganagtcctaaattattgatctntgctgccgtcgtctgcaacgtcggggtcccatcgtcggttcagtgggcgtgtatcgtaggacagaattcactctcacatccaacctaacctgaccaccctagaagtaattggttagaagtttattactgttacagtacctagtagtgggtcgcccgtntcgtacgtttcgggcggtacggtacgaaggtcgacagtanaacgaaacgactgaggtccncgacnc

SEQ ID NO: 389936 - DNA, 500 bp, Homo sapiens
  misc_feature: GZ8MTXP02ISZS1.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacacttatttagcctggtatcagcagaagccagggagagtccctaaattattgatctctgctgcgtccgccttgcaatcggggtccatctcggttcagtgggcggtggatctaggacagaattcactctcaccatcacaacctgcaccctagagatgttggaagtttattactgtacagacctagtagtggtgcccgctctagttttcggcggacggaccgaaggtcgacagataacgaaacgactagtggactcgacac

SEQ ID NO: 389937 - DNA, 512 bp, Homo sapiens
  misc_feature: GZ8MTXP02FWXNC.13.59.F04.1.454.CMB.2.raw
  modified_base (275)..(275): a, c, t, g, unknown or other
  modified_base (445)..(445): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggganagtccctaaattattgatctctgctgcgtccgccttgcaatccggggtccatctcggttccagtggcggtggatcgtaggacagaattcactctcaccatccaaccaacctgacaccctagaagagtgttgaagtttattactagttacacgacctatagtgtcgcccgntcgtatttcggacggacggaccgaaggtgacaggaactaacgaaaccgaacgtggtagctcgcaacc

SEQ ID NO: 389938 - DNA, 513 bp, Homo sapiens
  misc_feature: GZ8MTXP02JUC2U.13.59.F04.1.454.CMB.2.raw
  modified_base (458)..(458): a, c, t, g, unknown or other
  modified_base (500)..(500): a, c, t, g, unknown or other
  modified_base (505)..(505): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggagagtaccctaaattattgatctctgctgcgtccgtcctgcaacgtccggggtccagtctcggttcagtggcgggtgatcgtaggacagattcactctcacatcaccaacctgccacccagaacgattcgttaggaacgttattactagtcagtacctataggtgtcggcctctctacgtttcggnggacggtacaaggtcgactaggactaacgaaacgtacgtagnggtcncgacaccg

SEQ ID NO: 389939 - DNA, 520 bp, Homo sapiens
  misc_feature: GZ8MTXP02GRINP.13.59.F04.1.454.CMB.2.raw
  modified_base (226)..(226): a, c, t, g, unknown or other
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcattctcttggagacagagtcaccgtcacttgccgggnagtcaacgacattaacacttattagcctggtatcagcagaagccagggagagtaccctaaattatagatctctgctgcgtccgcttgcaacgtcggggtccatctggtcagtggcggtgatcgtaggacagaatcactctcacatcaccaacctgacaccctagaacgatgttaggtaagttattactgtcagacctatagtcggttacgccgntcgtacgtttcggcggacgggtaccgaaaggtcgacgtacggataacgaaaacgtacgtacggttgacgtcgactaaccg

SEQ ID NO: 389940 - DNA, 513 bp, Homo sapiens
  misc_feature: GZ8MTXP02GRUIW.13.59.F04.1.454.CMB.2.raw
  modified_base (202)..(202): a, c, t, g, unknown or other
  modified_base (296)..(296): a, c, t, g, unknown or other
  modified_base (351)..(351): a, c, t, g, unknown or other
  modified_base (420)..(420): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttgganacagagtcaccgtcacttgccgggcagtccacgacattaacacttattagcctggtatcagcagagccaggagagtccctaaattattgatctntgctgcgtccgctgcaactcggggtccatctcggttcagtggcgtgagtctaganagatcatctcacatcacacctgcaccctagaatatgttagaagtttatacgtgttacagacctattagnggtcgccgtctctaactttcggcggtacggaccgtaaggttacgcgaaggactaacgaaaacgaaacgtcggtagaccgtacggactaacccg

SEQ ID NO: 389941 - DNA, 554 bp, Homo sapiens
  misc_feature: GZ8MTXP02G9BP3.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtaccctaaattatgatctctgctgcgtccgccttgcacgtcggggtccatctcggttcagtgcggtggctcgtagacagattcactctcacatccaccaaacctgacccaccctagaaacgagttaggttagtaaaggtttacttaaccgttggtactaacggtaccttagtacgtcgggtcgcccggtcttcgtaacggttttcgggacgggtacgggacccgaaagggtccggactaggactaacgaaacgaacgtggtagcctgacctaaccg

SEQ ID NO: 389942 - DNA, 610 bp, Homo sapiens
  misc_feature: GZ8MTXP02IQOLR.13.59.F04.1.454.CMB.2.raw
  modified_base (201)..(201): a, c, t, g, unknown or other
  modified_base (312)..(312): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcgagtcacgacattaacacttattagcctggtatcagcagaagccagggagacgtaccctaaattattagatctctgctgcgtccncttgctacgtccggggtccagtcgtcggttcgagtcgggtcggtggatcgtaggacagtaatctactctacacactaccaccaacctcgaccaccctagaacgtattacggttaggtaaagtttagttactacggtactaacggtaccttaggttaacggtcgggttcgggtacccggtcttaccgttacgttttaccggggacggggtaaacggggtacccggtaaagggttcgaacgtaacggtaacttaaccggaaaacgtaaaccgtgggtacggccgttacggacctaaaccg

SEQ ID NO: 389943 - DNA, 489 bp, Homo sapiens
  misc_feature: GZ8MTXP02FVGWJ.13.59.F04.1.454.CMB.2.raw
  modified_base (200)..(200): a, c, t, g, unknown or other
  modified_base (214)..(214): a, c, t, g, unknown or other
  modified_base (224)..(224): a, c, t, g, unknown or other
  modified_base (372)..(372): a, c, t, g, unknown or other
  modified_base (379)..(379): a, c, t, g, unknown or other
  modified_base (382)..(382): a, c, t, g, unknown or other
  modified_base (397)..(397): a, c, t, g, unknown or other
  modified_base (400)..(400): a, c, t, g, unknown or other
tcagtcacgtactacacgaccggtgctcgatttagtacacacacttagggattggggcaggaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtnacttgccggnagtcacgacataacacttattagcctggtatcagcagaagccagggagagtccctaaattattgatctctgctgcgtccgcttgcaactcggggtccatctcgtcagtggcgtggatctaggacagaatcactctcacatcaccactncaccctnaanatgtagagttattangtnagactatagtcggtgccgctcatttcggcggtacgggacctaaacgggtgacaggataacgaaacgaatcggtggcttcgactaacccg

SEQ ID NO: 389944 - DNA, 668 bp, Homo sapiens
  misc_feature: GZ8MTXP02HTSP7.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagagtcaccgtcacttggccgggcagtcacgacattaacacttatttagcctggtatcagcagaagccagggagagtccctaaattattgatctctgctgcgtccgtccttgccgtaacgtccgggggtcccatccttcggttcagtgggcggtggatccgtaggacagtaacttcactcctacaccacttccaaccctaaaccctcgaccctaccccgttagaaaccgtagttaggtttaggtaaagtttttagttaccgttgttaccgtaacggtaaccctttaagttaacgggttcggggttaccgggtccccgtacgtttccgtacggttttttacccgggggaccggggttaaacgggggaaaccccggttaaaggggttacggtaccgtaaggacgtttaaaccgaaaaaccgggtaaaccgttaggggtcggtaaccgttcgggaaccttaaacccg

SEQ ID NO: 389945 - DNA, 570 bp, Homo sapiens
  misc_feature: GZ8MTXP02FZ81C.13.59.F04.1.454.CMB.2.raw
  modified_base (225)..(225): a, c, t, g, unknown or other
  modified_base (344)..(344): a, c, t, g, unknown or other
  modified_base (349)..(349): a, c, t, g, unknown or other
  modified_base (356)..(356): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacttggccggnagtcacgacattaacacttattagctggtatcagcagaagccagggagagtccctaaattattagatctctgctgcgtccgctgcaacgtcggggtccatctcggtcagtggcgtgatntaganagaattnactctcaacatcaaccaacctgaccaccctagaacgagttagttaggtaaagtttattacttaggtaccaagtaccgttaagtacggttaggtccgggtcccgtcgttaccgttacgtttttccggggaccggggtaacggggtaaaccgtaaagggttcgacctaagggaactaaccgaaaacgtaacggttagtcggacgttcgactaaccc

SEQ ID NO: 389946 - DNA, 585 bp, Homo sapiens
  misc_feature: GZ8MTXP02IOHHN.13.59.F04.1.454.CMB.2.raw
  modified_base (215)..(215): a, c, t, g, unknown or other
  modified_base (398)..(398): a, c, t, g, unknown or other
  modified_base (434)..(434): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacgttgccggcgagtcacgacataactacttattagcctgtatcagacagaagccgagggacgacgtacctaaagttatagtatctctgtctcgcgtccgtcttgctaaccggtccggggtccctacgttcgttcggttcgaggtggggtcgggttggagttcgtaaggataagtaatctacnctacacactccaaccgactcgctaccagtaaacgtnttaggttagtaagtttattacgtcgtactagaccttagtacgtcgggtccggccgtcttacgttacggttccgggtacgggaacggaccgtaaggtacgaccgaagtaacgtaacgaaaacgtacgtaggtacgtacgacgtacctaaccg

SEQ ID NO: 389947 - DNA, 572 bp, Homo sapiens
  misc_feature: GZ8MTXP02FZ9UJ.13.59.F04.1.454.CMB.2.raw
  modified_base (295)..(295): a, c, t, g, unknown or other
  modified_base (392)..(392): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttggccggcagtcacgacaattacacttatttagccttaggtatcagcagaacgccgagggagagtaccctaaattntagatctctgtctgtccgtccgtccttgcctaacgtccggggtcccagtccgttcggttacagggtgggcggtggatcgtagacagaattcacttcncacactcaacccgaacctgaccaccctagaagtatggttagtaaagtttagttactgttacacgtaccgtagtaggttcgggtccgccgtctcgtacggttttcggggacgggtacgggaaccgttaaggccgacgagtaaacaacgaaaacgacgttacggaggtccgagacctaaccg

SEQ ID NO: 389948 - DNA, 658 bp, Homo sapiens
  misc_feature: GZ8MTXP02I3I25.13.59.F04.1.454.CMB.2.raw
  modified_base (228)..(228): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggnagtcacgacattaacacttattagcctggtatcagcagaagccgagggagacgtaccctaaattattgatctctgctgccgtccgtcctgacgtaacgtccggggtccctagtccgttcggttaccgaggtcggggtcgggtcggagttaccgtagggaactaaggtaacttccaccttcctaccaacccacttacccaaaccctaacccttcgaccctaccccgtagaacgtagttacggtttaaggtaaagttttattacgtggttaccaacgtaccgttaagttacggtacgggtcggtccccgtcgttacgttacggttttccggggaccgggtacggggtaacccgtaaagggttcgaaccgtaacggtaacgtaaaccgtaaaacggtaacgttacggtacgggtcctacggtaacctaacccg

SEQ ID NO: 389949 - DNA, 527 bp, Homo sapiens
  misc_feature: GZ8MTXP02IIXTN.13.59.F04.1.454.CMB.2.raw
  modified_base (438)..(438): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcagtcacgacattaacacttattagcctggtatcagcagaagccagggagagtccctaaattattgatctctgctgcgtccgcttgcaacgtcggggtccatctcggttcagtggcggtgatctagacagtaatcactctcacctatccaccaacctcgccaacccctgaagtactgttaggaagtttattactgtcagtacctatagtggnggcccgtctctacgtttcggcgggacggtaccgaaaggtcgacgaagacgtaacgaaaacgtaacgtcggtacggctacggaccaaccg

SEQ ID NO: 389950 - DNA, 685 bp, Homo sapiens
  misc_feature: GZ8MTXP02IHISU.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaactacttattagcctggtatcagcagagccagggagacgtaccctaaattattgatctctgctcgccgtccgtccttgacgaaccgttccgggggtccccagttccgttccggttacgacgggttgggggtcgggttcggggtaacgttacgttacgggaactaagggaaactttaccaaccttaccctacctaaccctactaacccgtaaaccctaacccgttacgaccctaaccccgttaaagaacgtaacgttaggtttaaacggttaaagtttaccgttacgttacgtacgtaacgtaccttaaggttaggtccggggtccgtccgtcgttaccgttacggttttacgggaccgggtacggggtaaaccgtaagggtacgtaacgacgtaacgttaaacgaaacggtaaacgtcgggtcggtacctacggaccttaacccg

SEQ ID NO: 389951 - DNA, 613 bp, Homo sapiens
  misc_feature: GZ8MTXP02JLGE2.13.59.F04.1.454.CMB.2.raw
  modified_base (202)..(202): a, c, t, g, unknown or other
  modified_base (229)..(229): a, c, t, g, unknown or other
  modified_base (355)..(355): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcattctcttggganacagagtcaccgtcacttggcccgggnagtcacgacattaacacttattagcctggtatcagcagaagccgagggagagtaccctaaattattgatctctcgctgcgtccgccttgctaaccgtcgggggtacccattccgtcggtttccggnggtcgggtcggtggtacgtacgtaagactaagtacttacacttacctaccactactacccgaacctaccgtacgaccctaccgtagtaacgtagttaggttaaggttaacgtttacgttacgtagtaacgtacgtacgttagttacggtcggtccgtcccgtcgttacgttacggtttacgggacgggtaacgggacgtaacggtacgacgaagaacgtaacgtaaacgtaacgtacgtacggtacgtacgtactacg

SEQ ID NO: 389952 - DNA, 528 bp, Homo sapiens
  misc_feature: GZ8MTXP02GJ0GK.13.59.F04.1.454.CMB.2.raw
  modified_base (201)..(201): a, c, t, g, unknown or other
  modified_base (227)..(227): a, c, t, g, unknown or other
  modified_base (277)..(277): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggnagtcacgacattaacacttatttagcctggtatcagcagaagccaggganagtccctaaattattgatctctgctgcgtccgccttgcaacgtcggggtcccatctcggttcagtggcggtgagtcgtagacagaattcatctcacatacacaacctgcacctgaacatgtagtaagttattactagttcaacgtacctagtaagtcggttggcccgtacgtctaacgttttcggacgggtacggaaccgaaaggtcgcgaagaataacaaaaccgtaaacgtgtacggctcggacaaccg

SEQ ID NO: 389953 - DNA, 545 bp, Homo sapiens
  misc_feature: GZ8MTXP02GDLDS.13.59.F04.1.454.CMB.2.raw
  modified_base (201)..(201): a, c, t, g, unknown or other
  modified_base (228)..(228): a, c, t, g, unknown or other
  modified_base (254)..(254): a, c, t, g, unknown or other
  modified_base (279)..(279): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttggcccggnagtcaacgacattaacacttatttancctggtatcagcagaagccaggganagtccctaaattattgatctctgctgcgtccgcttgcaacgtcggggtcccagtctcggttcaggtggcggtgatctagacagaatcactctcaccataccaaccaacctcgaccaccctagaagtactgttaggaaagtttattaactgtacaacgacctagtaaggtggtcgcccgtctcgtacgttttcgggacgggtacgggaccgaaagggttcgacgaggaactaacgaaaacgtaacgtaggtgacgtcggaccaaccg

SEQ ID NO: 389954 - DNA, 542 bp, Homo sapiens
  misc_feature: GZ8MTXP02FM1K6.13.59.F04.1.454.CMB.2.raw
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggngagtcacgacattaacacttattagcctggtatcagcagaagccagggagagtaccctaaattattgatctctgctgcgtccgccttgcaacgtcggggtccagtctcggttcaggtggcggtggatcgtaggacagattcactctcaccatccaccaacctgaccaccctagaacgtattggttaggtaaagtttattacgtgtacagacctagtagtggtcgccgtctcgtacgttttcggggcggtaacggggaccgtaaagggtcgacgaagtacgtaacgaaaacgtacgtggtaggctggacctaaccg

SEQ ID NO: 389955 - DNA, 517 bp, Homo sapiens
  misc_feature: GZ8MTXP02HM7OH.13.59.F04.1.454.CMB.2.raw
  modified_base (225)..(225): a, c, t, g, unknown or other
  modified_base (260)..(260): a, c, t, g, unknown or other
  modified_base (334)..(334): a, c, t, g, unknown or other
  modified_base (377)..(377): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtcacttgccgggnagtcacgacattaacacttattagcctggtatcancagaagccagggagagtaccctaaatattgatctctgctgcgtccgcttgcaagtcggggtccagtctggttcngtggcgtgatctaggacagatcactctcacatcaccaaccgtnccacctgaacgtatgttaggtaatttattaactggttaccagaccctatagtggtggcccgtagtcctagttttcggcgggacgggaaccgaaaggtgcgagagtaacgaaacgaaccgtacgtaggccggtacgacacg

SEQ ID NO: 389956 - DNA, 565 bp, Homo sapiens
  misc_feature: GZ8MTXP02HX5RF.13.59.F04.1.454.CMB.2.raw
  modified_base (201)..(201): a, c, t, g, unknown or other
  modified_base (278)..(278): a, c, t, g, unknown or other
  modified_base (342)..(342): a, c, t, g, unknown or other
  modified_base (352)..(352): a, c, t, g, unknown or other
  modified_base (370)..(370): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcgagtcacgacattaacacttattagcctggtatcagcagaagccgaggganacgtacctaaattatgatctctgctgccgtccgtcctgctaactcgtcgggtccatcgtcgttnggtggcgtgntcgaggacagatcactcncaccatacaccactcgaccaccgagtaacgagttggttaggttaagttacttacgtcgtacaagtacctaagtacggtcggtcggtacccgtcgttcgtacggtttttccggggacggtacggggaacggtacgggtacgtaacgacggtaacgtaacgaaaacggtaaccgtaggttacgacgtacggaacccg

SEQ ID NO: 389957 - DNA, 565 bp, Homo sapiens
  misc_feature: GZ8MTXP02G5SI1.13.59.F04.1.454.CMB.2.raw
  modified_base (203)..(203): a, c, t, g, unknown or other
  modified_base (229)..(229): a, c, t, g, unknown or other
  modified_base (276)..(276): a, c, t, g, unknown or other
  modified_base (288)..(288): a, c, t, g, unknown or other
  modified_base (296)..(296): a, c, t, g, unknown or other
  modified_base (298)..(299): a, c, t, g, unknown or other
  modified_base (301)..(301): a, c, t, g, unknown or other
  modified_base (308)..(308): a, c, t, g, unknown or other
  modified_base (386)..(386): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagagtcaccgtcacttggccgggnagtcacgacattaacacttattagcctggtatcagcagagccagganagtcctaaattnttgatctntnntnccgtacnccttgcaacgtcggggtccatctcgtcagtggcggttgatcgtaggacagaattcatctcacgataccacctaaccgnccacctagagtatgttagaagtttatagtgtacacgtacctagtagtcgggtcgcccgtcgttcttaacggttttccggggacgggaacggggtaacccgtaaaacgggttgacccgaaggtaacttaaccgaaaacggtaaccgtcggttaacgggacttcccggactttaaaccccg

SEQ ID NO: 389958 - DNA, 581 bp, Homo sapiens
  misc_feature: GZ8MTXP02HQ5YW.13.59.F04.1.454.CMB.2.raw
  modified_base (230)..(230): a, c, t, g, unknown or other
  modified_base (265)..(265): a, c, t, g, unknown or other
  modified_base (279)..(279): a, c, t, g, unknown or other
  modified_base (405)..(405): a, c, t, g, unknown or other
  modified_base (432)..(432): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagacgtcaccgtcacgttcgccgggnagtcacgacattaacacttattagcctggtatcancagaagccaggganagtccctaaattattgatctctgtctgcgtccgtccttgctaaccgttccgggggtcccagtccgttcggttccagggtcggtcgggtggagttcgttaaggacaagtaacttcactctacaaccnttccaaccgaaccttgaccttacccgngaatagttgttaggtaaagttttattacgttggacctaacgccttaaagtggtggttccgccggtactcgtacggttttccgggagggtaccggtaccgtaggtcgacgtaagtacgtaacgaaaacgaacgttcggcgacgtcactac

SEQ ID NO: 389959 - DNA, 618 bp, Homo sapiens
  misc_feature: GZ8MTXP02HCAPL.13.59.F04.1.454.CMB.2.raw
  modified_base (202)..(202): a, c, t, g, unknown or other
  modified_base (230)..(230): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctccctgtctgcatctcttgganacagacgtcaccgtcacgttggccgggngagtcacgacattaacacttattagcctggtatcagcagaagccgagggagagtaccctaaattattagatctctgctgccgtccgtcctgctaacgtccggggtccagtctcggttcagtgggcggtggactcgtaggacagtaattcactctacaccatacccaacctaaccctcgacccacccgtagaaacgtagttacggtttaaggaaacgttttaagttaccgttagtaacctaacgttaacccttaagttaacgggttcgggtcccggtacccgtacgttccgttaacggttttcggggacgggtaacgggtaccgaagggtcgacgtaagtactaacgaaaacggtaacgttcggtacggtacctacggaccttaacccg

SEQ ID NO: 389960 - DNA, 491 bp, Homo sapiens
  misc_feature: GZ8MTXP02FYAC1.13.59.F04.1.454.CMB.2.raw
  modified_base (426)..(426): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtccctaaattattgatctctgctgcgtccgcttgcaatcggggtcccatctcggttcagtggcggtggatctaggacagattcactctcacatcaccacctgcacctgacatgtaggaagttattactgtcagactatagtggtgccgntcatttcggaggacgggaccaaggtcgacaggactaacgaaaacgacgtacgtggctcgacaacc

SEQ ID NO: 389961 - DNA, 515 bp, Homo sapiens
  misc_feature: GZ8MTXP02FO7L6.13.59.F04.1.454.CMB.2.raw
  modified_base (227)..(227): a, c, t, g, unknown or other
  modified_base (439)..(439): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggnagtcacgacattaacacttatttagcctggtatcagcagaagccagggagagtaccctaaattattgatctctgctgctccgcttgcaacgtcggggtcccatctcggttcagtgggcggtggatcgtaggacagattcactctcaccatcaccacctgaccaccctagaacattagtcggtaaagttattactgtacagacctatgtaggngccgctcgtatttcggcggtacgggaccaaggtcgacaggactaacgaaaacgacgttggtacggcacgacaaccg

SEQ ID NO: 389962 - DNA, 555 bp, Homo sapiens
  misc_feature: GZ8MTXP02INUD3.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacataacacttattagcctggtatcagcagaagccagggagagtaccctaaattatgatctctgctgccgtccgccttgcaacgtccggggtccagtctcggttcagtgggcggtggatcgtaggacagtaattcactctacaccactccacccaacctcgaccaccctagaagagttggttaggtaaagtttacttacgttgtacgtacgtacctagtaggtggtcggcccgtctcgtacgttttcgggcgggtacggggacccgtaaagggtcgaccgaggaactaacgaaaacgtaacgtggtcggctcgactaaccg

SEQ ID NO: 389963 - DNA, 516 bp, Homo sapiens
  misc_feature: GZ8MTXP02GWUR4.13.59.F04.1.454.CMB.2.raw
  modified_base (227)..(227): a, c, t, g, unknown or other
  modified_base (274)..(274): a, c, t, g, unknown or other
  modified_base (342)..(342): a, c, t, g, unknown or other
  modified_base (364)..(364): a, c, t, g, unknown or other
  modified_base (376)..(376): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcattctcttggagacagagtcaccgtcacttgccgggnagtcacgacattaacacttattagcctggtatcagcagagccagganagtccctaaatattgatctctgctgcgtccgcttgcaacgtcggggtccatcgtcgtcagtggcgtgntctaggacagatcactctcacntcaaccaccgtnccacctagaagtatgtagaagtttatactgttcaagtacctagtagtggttcgccgtctcgtacgtttcggcgggacggaccgaaaggtcgacgaagacgttaacgaaaaccgaaacgttacgggtcgtactcgactacg

SEQ ID NO: 389964 - DNA, 529 bp, Homo sapiens
  misc_feature: GZ8MTXP02FJUEX.13.59.F04.1.454.CMB.2.raw
  modified_base (279)..(279): a, c, t, g, unknown or other
  modified_base (300)..(300): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttggccgggcgagtcacgacattaacacttatttagcctggtatcagcagaagccaggganagtaccctaaattatgatctntgctgcgtccgcttgacacgtcggggtcccatctcgtcagtggcggtgatcgtagacagatcactcacacatccaaccacctgccaccgtagaagtatgttaggtaacgttattacgtagtcaacgtacctagtacggtggtcggcccgtacgttctacgttttccgggacgggtacggaccgaaggtcgacagagtaacgaaaacggtactcggtagctacgctaacc

SEQ ID NO: 389965 - DNA, 585 bp, Homo sapiens
  misc_feature: GZ8MTXP02HA0F5.13.59.F04.1.454.CMB.2.raw
  modified_base (274)..(274): a, c, t, g, unknown or other
  modified_base (287)..(287): a, c, t, g, unknown or other
  modified_base (381)..(381): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccggcagtcacgacattaacacttattagcctggtatcagcagagccgagganagtacctaaattntgatctctgctgccgtcgtccttgcacgtcggggtcccatcgtcgttcaggtcgggcggtggacttcgaggacagtacttcactctacactacnccaacctaccgcacacccgtagaagtatgtttaaggaagtttaatccttaggttacaacggtaccttaagtcggttcgggacgtcccggtcttccgttaacggttttccggggacggggtaacgggtaaacccggtaggggtacaaccgggtaaagtaacgtaacgtaaacgtaacggtacggtacggtacgtacgtacgtacg

SEQ ID NO: 389966 - DNA, 502 bp, Homo sapiens
  misc_feature: GZ8MTXP02GB9YO.13.59.F04.1.454.CMB.2.raw
  modified_base (206)..(206): a, c, t, g, unknown or other
  modified_base (292)..(292): a, c, t, g, unknown or other
  modified_base (344)..(344): a, c, t, g, unknown or other
  modified_base (388)..(388): a, c, t, g, unknown or other
  modified_base (427)..(427): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagaaagngtcaccgtcacttgccggcagtcacgacattaacacttattagcctggtatcagcagaagccaggagagtcctaaatattgatctntgctgcgtccgcttgcaagtccggggtcccatctcggttcagtgggcggtgntctaggcagaattcactctcacatcaccaactgacacctgaaantagttggaattattactgtacagacctatagtgtcgccnctctagtttcggcggaaggaccaaagggtcgacgtacgacgtaacgaaacgtacgtacgtacgctacgcactacg

SEQ ID NO: 389967 - DNA, 515 bp, Homo sapiens
  misc_feature: GZ8MTXP02HPO9K.13.59.F04.1.454.CMB.2.raw
  modified_base (373)..(373): a, c, t, g, unknown or other
  modified_base (384)..(384): a, c, t, g, unknown or other
  modified_base (389)..(389): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactattagcctggatcagcagaagccagggagagtccctaaataattgaatctctgctgcgtccgcttgcaactcgggggtcccatctcggttcagtggcgtggattcaggacagaattcactactcacacncaccaaccacncaccncgaagatgttagtaaggttattaattatacacgtactatagtggtcggccgctctacgttcggtcgggacggacgaacggacgacgagaacgtaacgaaaacgaacgtacgtagcgtacgacgacg

SEQ ID NO: 389968 - DNA, 576 bp, Homo sapiens
  misc_feature: GZ8MTXP02II7Q1.13.59.F04.1.454.CMB.2.raw
  modified_base (195)..(195): a, c, t, g, unknown or other
  modified_base (201)..(201): a, c, t, g, unknown or other
  modified_base (215)..(215): a, c, t, g, unknown or other
  modified_base (225)..(225): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctnttgganacagagtcaccgtnacttgccggnatcacgacattaacacttattagcctggtatcagcagaagccagggagagtaccctaaattattagatctctgctgcgtccgtcctgacaacgtccggggtacccatcgtcggttcagtgggcgtggatcgtaaggacaagtaatcactctacaccatcccaaccaaacctcgacacccgtgaaacgagttacggttaggtaaagttttaacttaacgtaggttaccagtaaacccttagttaacggtggttaccggacccggtctacgttacgtttacggggacgggtaacggaccgtaaagggtacgacgtaagactaacgaaacgaacgtcgaggcctacggacaacc

SEQ ID NO: 389969 - DNA, 554 bp, Homo sapiens
  misc_feature: GZ8MTXP02JKGOY.13.59.F04.1.454.CMB.2.raw
  modified_base (201)..(201): a, c, t, g, unknown or other
  modified_base (229)..(229): a, c, t, g, unknown or other
  modified_base (352)..(352): a, c, t, g, unknown or other
  modified_base (390)..(390): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttcggccgggngagtcaacgactaacttaacacttattagcctggtatcagacagagccgagggagataccctaaattatagattctctgctgccgtccgacttgcgtaacggtccggggtccatcgtccggtnaggtggcggtgtatcgtaggactagattcactctcacnctccacacctgaccacctagaagtattgtaggtaatttacgtatcggtaacagtaccttaagtgggtcggtacgtcccgtcgtcgtacgtttacgggcgggtaaacggaccgtaaggtcgacgaggtaactaacgaaacgtacgtcgtacggctacgactaccg

SEQ ID NO: 389970 - DNA, 580 bp, Homo sapiens
  misc_feature: GZ8MTXP02IGGEV.13.59.F04.1.454.CMB.2.raw
  modified_base (200)..(200): a, c, t, g, unknown or other
  modified_base (205)..(205): a, c, t, g, unknown or other
  modified_base (213)..(213): a, c, t, g, unknown or other
  modified_base (224)..(224): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccatcctccctgtctgcatctctgganacagntcaccgtnacttggccggnagtcacgacataacacttattagcctggtatcagacagaagccgagggagacgttaccctaaattactagatctactgctgacgtccgctttgactacggtccggggtccacgtccgtcggttcaggttcggggcggtggacgtcgtaggacgtagaaactttcactctaccacactaccacccacctcgccaccgtagaacgtagttaggtttaggtaacgtttaattacgtcgtacaacgtaccttagtaggtggtccgcctcgtacttacgtttcggggacggtacgggaaccgaaggtcggactagtaagtaacgaaaacgtaacgttggacggtacgtacgaccttaaccg

SEQ ID NO: 389971 - DNA, 543 bp, Homo sapiens
  misc_feature: GZ8MTXP02F5487.13.59.F04.1.454.CMB.2.raw
  modified_base (228)..(228): a, c, t, g, unknown or other
  modified_base (378)..(378): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttggccgggngagtcacgacattaacacttattagcctggtatcagcagaagccgagggagagtaccctaaattattgatctactgctgcgtccgccttgcaagtccggggtccatcgtcgtcagtggcggtggatcgtaggacagaattcactctcacntcaccactgcacctagaagactgtaggaagtttatactgttacagacctagtaggtaggtcgcccgtcttacgtacgttttcgggacgggtacgggtaacccgaaagggtcgacgacgtaagtaaccgaaaacgtaacgtgggtacgacttacggacctaaaccg

SEQ ID NO: 389972 - DNA, 538 bp, Homo sapiens
  misc_feature: GZ8MTXP02FMBHB.13.59.F04.1.454.CMB.2.raw
  modified_base (201)..(201): a, c, t, g, unknown or other
  modified_base (276)..(276): a, c, t, g, unknown or other
  modified_base (449)..(449): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcagtcacgacattaacacttattagcctggtatcagcagaagccaggganagtccctaaattatgatctctgctgccgtccgccttgcaacgtcggggtcccatcgtcgtcgagtgggcggtggatcgtagacagattcactctcacataccaccaacctgccaccctgaagtatgttaggaagttattactgtacagtacctagtaggtggtcggacccgtnttacgtacgttttccggggacgggtaacgggacccgtaagggttcgaccgaggaactaacgaaaacgtacgtggtagcgtacgctaacc

SEQ ID NO: 389973 - DNA, 521 bp, Homo sapiens
  misc_feature: GZ8MTXP02FSD1M.13.59.F04.1.454.CMB.2.raw
  modified_base (277)..(277): a, c, t, g, unknown or other
  modified_base (296)..(296): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggcgagtcacgacattaacacttattagcctggtatcagcagaagccaggganagtcctaaattatgatctntgctgcgtccgcttgcaagtcggggtccatctcggtcagtggcgtgatcgtagacagattcactctcacatcaccactgacacctagacgtatagttagtaacgttattacgtgtacagtacctataggtggtcgccgtctcgtacgtttcgggacggtacgggaccgtaagggtcgacgaaggtactaacgaaaacgacgttacgggtcgtacgtacgactacg

SEQ ID NO: 389974 - DNA, 543 bp, Homo sapiens
  misc_feature: GZ8MTXP02H1TSV.13.59.F04.1.454.CMB.2.raw
  modified_base (334)..(334): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtcacttgcgggcagtcacgacattaacacttattagcctggtatcagcagaagccagggagagtaccctaaatattagatctctgctgcgtccgcttgcaacgtcggggtccatctcggttnaggtgcggtgatcgtagacagattcactctacaccataccaccaaacctgaccaaccctgaaagattggttaggtaaatttatactgtacagtacctagtaggtggttcggcccgtctacgtacgtttaccgggcggtaacgggaccgtaaacggtgaccgaggtaactaacgaaaacggaaacctggtcgtaccgtacggaccaaccg

SEQ ID NO: 389975 - DNA, 534 bp, Homo sapiens
  misc_feature: GZ8MTXP02GN4SH.13.59.F04.1.454.CMB.2.raw
  modified_base (201)..(201): a, c, t, g, unknown or other
  modified_base (226)..(226): a, c, t, g, unknown or other
  modified_base (274)..(274): a, c, t, g, unknown or other
  modified_base (296)..(296): a, c, t, g, unknown or other
  modified_base (449)..(449): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagagccaggganagtacctaaattattagatctntgctgcgtccgctgacaacgtccggggtccatccgtcgttcaggtgggcggtgtagtctagggaacagaaattcactctacacatccaaccactcgcacctagacgatgtagtaagtttatactgtacaagtacctagtaggtggcgtcccgntccgtagtttcggacggacggaaccgaacggtgaccgaagtactaacgtaaaaccgtagtacgtcgggtactacggtactaaccg

SEQ ID NO: 389976 - DNA, 545 bp, Homo sapiens
  misc_feature: GZ8MTXP02H0P3J.13.59.F04.1.454.CMB.2.raw
  modified_base (201)..(201): a, c, t, g, unknown or other
  modified_base (466)..(466): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagacgtcaccgtcacttgccgggcagtcacgacattaacacttattagcctggtatcagcagaacgccgagggagacgttaccctaaattatgatctctgctgcgtccgtcctgctaagtccggggtaccctagtcttcggtcagtgggcgtggatcgtagacagtaatcactctacaccatccaaccacctcgacaccctagaacgattggttagtaagtttatacgtagttacagtaacctagttagaggttcggcccgtntacgttacgtttcgggtacggacggacgtaacggcgtacgaagactaacgaaacgtaacgtggtaggactcgactaccg

SEQ ID NO: 389977 - DNA, 530 bp, Homo sapiens
  misc_feature: GZ8MTXP02GUE7N.13.59.F04.1.454.CMB.2.raw
  modified_base (202)..(202): a, c, t, g, unknown or other
  modified_base (343)..(343): a, c, t, g, unknown or other
  modified_base (399)..(399): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagatatcagatgtgacatccagatgacccagtctccatccctccctgtctgcatctcttgganacagagtcaccgtcacttggccgggcgagtcacgacattaacacttattagcctggtatcagcagaagccagggagagtaccctaaattattgatctctgctgcgtccgccttgccaagtccggggtccagtctcggttcnggtggcggtggatcgtaggacagaattcactctcacatcaccactgcacctgaacntagttggtaagttattactgtacagacctagtaggtggtcggcccgtcgttctacgttttcgggacgggtacgggaccgtaagggtcgacgaggaacttacgaaaacgtaacgtggtcggcgtacggaacc

SEQ ID NO: 389978 - DNA, 627 bp, Homo sapiens
  misc_feature: GZ8MTXP02JR3QM.13.59.F04.1.454.CMB.2.raw
tcagtcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctaggtaaaacccaaacaggccctcacagtgacctgcaccgtctctgggctttcactcaatagaagtacagtgtgtatgagttggattcgcacgtccccagggacggccctgggagtggcttgcacgcattgattgggatgatgatacaaaaatataacaacacatctatagaacgtaccaggtctcacccatccgtaccaaacgacattcctacaacggactacccgaaggttcgtacctttaaggaactacggaaaccctaacgtttcgggaccctaggtacggaaccacgtacggcctaaccgttatttactacgggttacactaacgtaactaacgaaaacgtagttactttacgtaacgtaaccgggttagtacgggtaccgttcggtacggggaccggaacgggggttcccg

SEQ ID NO: 389979 - DNA, 542 bp, Homo sapiens
  misc_feature: GZ8MTXP02GL7MN.13.59.F04.1.454.CMB.2.raw
  modified_base (205)..(205): a, c, t, g, unknown or other
  modified_base (236)..(236): a, c, t, g, unknown or other
  modified_base (418)..(418): a, c, t, g, unknown or other
  modified_base (436)..(436): a, c, t, g, unknown or other
  modified_base (531)..(531): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgctatctcttgganacagacgtccaccgtctacgttcggccgggnagtcaacgactaattaactacttatttagccttggtatcagcaagaacgccgagggacgagtaccctaaattattgatctctgcgtgtccgtccgcttacgctaaccgtcggggtcccagtctcggttcagtggcggtgagtcgagacagtactcatctcacatacaccaactgcaccgtanagtatgtagtaacgtttntactagtcaagacctagtagtcggtcgccccgtgtctaacggtttcggacgggaacggtaacgaaggtccacgagactaacgaaacgtacgtagngcacgactacg

SEQ ID NO: 389980 - DNA, 562 bp, Homo sapiens
  misc_feature: GZ8MTXP02I7O5O.13.59.F04.1.454.CMB.2.raw
  modified_base (202)..(202): a, c, t, g, unknown or other
  modified_base (227)..(227): a, c, t, g, unknown or other
  modified_base (268)..(268): a, c, t, g, unknown or other
  modified_base (392)..(392): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcattctcttgganacagagtcaccgtcacttgccgggnagtcacgacattaacacttattagcctggtatcagcagaanccagggagagtaccctaaattattagatctctgctgcgtccgccttgcaacgtccggggtcctatcctcggttcagtggcgtggagtctaggacagtaaatcactctcaccatcaccgtaaccncaccacagaagtagttagttaggttaattattacgtagtactaacgtacgttagtacggtcggtcggacccgtcgttaccgttacggtttacgggacgggtaacggtaccgtaacgggtacgacgtaagtaacgtaacgaaacgtacgtacgtacgtacgtcgacctacg

SEQ ID NO: 389981 - DNA, 585 bp, Homo sapiens
  misc_feature: GZ8MTXP02GL6D3.13.59.F04.1.454.CMB.2.raw
  modified_base (201)..(201): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccgagggagagtaccctaaattatgatctctgctgcgtccgccttgcaacgtccggggtccattcgtcggttcagtgggcgtggatcgtagacagtaacttcacttcctcaccactaccacccaacctgacccacccgtagaagagttaggttaggtaagtttattacgtgtactaacgtaccttagtaggtcggtacggcccgtcgtacgtacgttttacggggcgggttacggggaccgtaaagggtcgaaccgtaagaaacgttaaccgaaaacggtaaaccggttggtaacggtacgttcggtacctaacccgg

SEQ ID NO: 389982 - DNA, 682 bp, Homo sapiens
  misc_feature: GZ8MTXP02HMMUZ.13.59.F04.1.454.CMB.2.raw
  modified_base (207)..(207): a, c, t, g, unknown or other
  modified_base (231)..(231): a, c, t, g, unknown or other
  modified_base (532)..(532): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttaggaaacngacgtcaccgtcacgttgccgggngagtccaacgactaattaactacttattacgcctggtatcagcagaacgccgaagggacgacgtaccctaaatttactagactctctgctcgccgtccgccttgacgtaacggtccccggggtaccctagttccgttcggttcgtacgggttcgggccggggttaggtacgttacgttacggggaactaacgtaaactttccaacctttcctaccaacctacttacccaacccgttaaaccgccgaccctaacccgtacgtaacgtacgttaggttaaaggttaaactttacggtttaacnggttaactaacgtaaccttagtacgggtcggttccggcccgttcgttaacgttcggtttcccggggacggggttaaccggaaccggtaggtacgaccgaagtaactaaccgaaaacgtaacgtggtaccggactaccggacgtaacctcg

SEQ ID NO: 389983 - DNA, 568 bp, Homo sapiens
  misc_feature: GZ8MTXP02HOQ4Q.13.59.F04.1.454.CMB.2.raw
  modified_base (201)..(201): a, c, t, g, unknown or other
  modified_base (228)..(228): a, c, t, g, unknown or other
  modified_base (281)..(281): a, c, t, g, unknown or other
  modified_base (302)..(302): a, c, t, g, unknown or other
  modified_base (462)..(462): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttggccgggngagtcacgactattaaactacttaattagcctggtatcagcagagccaggganacgtacctaaattatgatctntgctgctccgcttgcacgtcggggtccatctcggttcgagtgggcgttggatcgtaggacagtatcactctcacatcccaaccgaacctcgaccaccctagtaagagttggtaaggtaactttagtactaggtacaacgtactagtagtcggtcgccgtnttcgtacggttttcggggacggaacggggttaccgtaaaggtcgaccgaaggtaaactaaccggtaaaaccgtaagttcggttaacggcttacggtacgtaaaccc

SEQ ID NO: 389984 - DNA, 640 bp, Homo sapiens
  misc_feature: GZ8MTXP02F4WL7.13.59.F04.1.454.CMB.2.raw
  modified_base (236)..(236): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgctatctcgttaggagacagagtccaccgtctacgttcggcccgggngagtaccacgaactaattaactactttattcgccgtggtactcagcaaggaacgccggagggtaagacgttaaccttaaatttattgtactctcgtgtactggtcctcccggtacttcgacgtaaccgggttcccggggtaccctagttccggttcggtaacgtgggttcggggcgggttgagttaccgtaagggaactagtaaacttctaactcctacaacctactacccacccgtaacctcgaccaaccgtagaaagttagttaggttaaggttaaacttagttacttacggtacctaagtaccgttagtaggttcggtccggtaccgtcgttcgtacggtttcgggacggtacggacgacggtgacgagaacgtaacgaagtacgtgcgtacgacgactac

SEQ ID NO: 389985 - DNA, 641 bp, Homo sapiens
  misc_feature: GZ8MTXP02GQV56.13.59.F04.1.454.CMB.2.raw
  modified_base (203)..(203): a, c, t, g, unknown or other
  modified_base (232)..(232): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagacgtcaccgtcacgttcggccgggngagtcacgacattaacacttattagcctggtatcagcagagccgagggagagtacctaaattattagattctctgtcgtcgtccgtccgtccgttcgaccgtaaccggttccgggggtccctagttccgttcgggtttccgaggtcgggggtccggttagggtacgttaccggtagggaacgtaaaggtaaacttttcccaaaccttccgtaccaaccctaacttacccgaaaccctaaacccgttcgacccaaccccgtagaaacgtacgttaggttaggtaacgtttattacctaggtaccagtaccttagtaggttcgggcgtccgtacttcgtaagtttccgggaggtaacggacgtaagtcgacaagactaacgaaacggtactcggtacgcgttacgactaac

SEQ ID NO: 389986 - DNA, 565 bp, Homo sapiens
  misc_feature: GZ8MTXP02GNGYY.13.59.F04.1.454.CMB.2.raw
  modified_base (201)..(201): a, c, t, g, unknown or other
  modified_base (227)..(227): a, c, t, g, unknown or other
  modified_base (371)..(371): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggngagtcacgacattaacacttattagcctggtatcagcagaagccgagggagagtaccctaaattattagatctctgctgcgtccgccttgcacgtccggggtccatctcggttcagtgggcgtggatcgtagctagtaacttcnctctcacatcacccgaactgccacctagaagtatgttaggtaagtttattacgtagtcaacggtaccttagtaggtaggtcggtcccgtcttcgttaacggttttccgggagggggtacgggtaaacccgaaagggttcggaccgtaaggagttaacgaaaacggtaaccttgggtagcgttacggacctaacg

SEQ ID NO: 389987 - DNA, 617 bp, Homo sapiens
  misc_feature: GZ8MTXP02HI0NR.13.59.F04.1.454.CMB.2.raw
  modified_base (204)..(204): a, c, t, g, unknown or other
  modified_base (241)..(241): a, c, t, g, unknown or other
  modified_base (281)..(281): a, c, t, g, unknown or other
  modified_base (356)..(356): a, c, t, g, unknown or other
  modified_base (410)..(410): a, c, t, g, unknown or other
  modified_base (507)..(507): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcttgganacagacgtcaccgtcacgttgccgggcgagtcacganattaacacttattagcctggtatcagcagagccgaggganagtaccctaaattatgatctctgctgccgtccgtccttagctaaccggtccggggtcccagtccgttcggttccnggtcgggtcgggtgacgttcgtagggtacaaggtaacttactacctctacaccnctaccaccgtacctgacctaccctagaacgtagttgttaagggattttaattacgtacgttcacggtaccttaagtacggttggtccggcccccgtnttacgtacggttttccgggacgggtacggggttaaaccagggttacgacgaaccgttaaagaacccgtaaaaaccgtagttcgggttaacggcgaacgttccgtaaaccg

SEQ ID NO: 389988 - DNA, 660 bp, Homo sapiens
  misc_feature: GZ8MTXP02I3MG0.13.59.F04.1.454.CMB.2.raw
  modified_base (643)..(643): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggcctccagataccagatgtgacatccagatcgacccagtcctccactcctccctgtctgcacttctcgttggagacagacgtccacccgtctacgttcggcccgggcagtaccacgactaacttaactactttattacgccttaggtactcgaagacgaagaacgaccgaaggggtacacgtttaaccctaaatttatacgtattccgtctcgtccgtcggtcccgtaccgtccgttggaccgtaaccggttcccggggtcctagttccggttacggttacgacgggttggggccgttaggacttaccggtaaggtaactaagttaccttaccacttcctacaaccgtactacccaacccgtacctcaccaccgttagagttaagttaggtttagtaacgtttacttacgtgtactacgtacttaggtacggtcggtcgtccgtgttcggttaacgttcgggacggttacggaacgtagtcgaaacgcggttaaacaacgaacgttacgnggtcgctacgacctacg

SEQ ID NO: 389989 - DNA, 527 bp, Homo sapiens
  misc_feature: GZ8MTXP02IENS1.13.59.F04.1.454.CMB.2.raw
  modified_base (194)..(194): a, c, t, g, unknown or other
  modified_base (277)..(277): a, c, t, g, unknown or other
  modified_base (298)..(298): a, c, t, g, unknown or other
  modified_base (333)..(333): a, c, t, g, unknown or other
  modified_base (376)..(376): a, c, t, g, unknown or other
  modified_base (490)..(490): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctnttggagacagagtcaccgtcacttggccgggcagtcacgacattaacacttattagcctggtatcagcaagaagccgaggganagtaccctaaattatgatctntgctgcgtaccgcttgacaacgtccggggtacccngtcgtcggttcagtgggcggtgatcgtaggacagtaactctanctacacatacaccaacctgaccacctagaacgtatggttagtagtttattactgtacagtactagtagtggtcgccgtctcgtacgtttcggcggtacgacgaggtcgacgtanacgtaacgaaacgtaacgtgtggactacgactaaccg

SEQ ID NO: 389990 - DNA, 602 bp, Homo sapiens
  misc_feature: GZ8MTXP02ILQ1I.13.59.F04.1.454.CMB.2.raw
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatcagcagaagccgagggagagtaccctaaattattgatctctgctgcgtccgcttgcaacgtccggggtccagtcttacggttcacggtgggtccgggtagggtactaccgtaggaccaaggtaacttccaactcttcacctatacccaacccaacctcgaccaaccccttgaaagattaggttagggtaatttagtactggtaccaaggtacccttagtacgtggttccggcccgtctaccttagttttaccgggcgggtaaacgggaacccgtaaacggggttgaccgaaggtaactaaccgaaaaacgtaccgttaggcggtactacggaccctaaacccg

SEQ ID NO: 389991 - DNA, 548 bp, Homo sapiens
  misc_feature: GZ8MTXP02GVANI.13.59.F04.1.454.CMB.2.raw
  modified_base (229)..(229): a, c, t, g, unknown or other
  modified_base (375)..(375): a, c, t, g, unknown or other
  modified_base (378)..(378): a, c, t, g, unknown or other
  modified_base (386)..(386): a, c, t, g, unknown or other
  modified_base (395)..(395): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagagtcaccgtcacgttggccgggnagtcacgacattaacacttattagcctggtatcagcagaagccaggagagtaccctaaattattgatctactgctgccgtccgtccttgcaacgtccggggtcccagtctcggtgagtgggcggtggatcgtagacagaatcatcnacntcacactncacctgaantgttgagttatatgtcagtacctagtacgtggtcggccgtacgtcgttacgtttcgggacggacggggaaccgtaaagggttcgaaccgaggtaaacttaaccgaaaacggtaaaacccgttgggtaacgggaccttcgggacccttaaaccg

SEQ ID NO: 389992 - DNA, 496 bp, Homo sapiens
  misc_feature: GZ8MTXP02GT83C.13.59.F04.1.454.CMB.2.raw
  modified_base (215)..(215): a, c, t, g, unknown or other
  modified_base (226)..(226): a, c, t, g, unknown or other
  modified_base (436)..(436): a, c, t, g, unknown or other
  modified_base (491)..(491): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggnagtcacgacattaacacttatttagcctggtatcagcagagccagggagagtaccctaaattattgatctctgctgcgtccgccttgcaacgtcggggtccatctcggttcagtggcgtggatctaggacagaattcactctcacatcaccaacctgccaccctagagatgttagaagtttattactgtcagacctatagtggtgcccgntctacgtttcggcggaggaccaaggtgcagataacgaaacgtaacttgcggctancaacc

SEQ ID NO: 389993 - DNA, 552 bp, Homo sapiens
  misc_feature: GZ8MTXP02I4PI8.13.59.F04.1.454.CMB.2.raw
  modified_base (369)..(369): a, c, t, g, unknown or other
  modified_base (381)..(381): a, c, t, g, unknown or other
  modified_base (419)..(419): a, c, t, g, unknown or other
  modified_base (479)..(479): a, c, t, g, unknown or other
tcagtcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaaatagaagtacagtgtgtatgagttggattcgtcacgtccccagggaagcccctgggagtggctgcacgcattgattgggatgatgatacaaaatatacaanacatctatgaanaccagctacaccatacctaccaagactatctacacganacaagtcgtacttaagactacgaacctaacgttcggaccctgacgacacgagcactattntgtcgacacatacaaagtacgactttacacgtaaggtcgtacggtacggtcgtacggggacgaacggggtccg

SEQ ID NO: 389994 - DNA, 514 bp, Homo sapiens
  misc_feature: GZ8MTXP02HW2HN.13.59.F04.1.454.CMB.2.raw
  modified_base (343)..(343): a, c, t, g, unknown or other
  modified_base (349)..(349): a, c, t, g, unknown or other
  modified_base (444)..(444): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttgccgggcgagtcacgacattaacacttatttagcctggtatcagcagaagccagggagagtcctaaattattgatctctgctgcgtccgtcctgcacgtcggggtccagtctcgttcagtggnggtggntcgtagtacagtaattcactctcaccactcaacccaacctcgccaccctgaacgatgttaggtaagtttattactgtcagactatagtgtcgccnctctagtttcggcggtacggccgaaggtcgacgagataacgtaaacgaacgtggtacgctacgacaaccg

SEQ ID NO: 389995 - DNA, 574 bp, Homo sapiens
  misc_feature: GZ8MTXP02H1O47.13.59.F04.1.454.CMB.2.raw
  modified_base (279)..(279): a, c, t, g, unknown or other
  modified_base (292)..(292): a, c, t, g, unknown or other
  modified_base (560)..(560): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccatcctccctgtctgcatctcttggagacagacgtcaccgtcacgttcggccgggcagtcacgacattaacacttattagctggtatcagcagaagccgaggganacgtacctaaatnttgatctctgctgccgtaccgtcttgactacggtccggggtccctatccgtcgttcgacgtgggggcgtggactacgtagggacaagtaacttccactccactaccactacccgaaccctacctgacccaccgtagtaagtagtttgttaaggttaaatttcgttactaggtaccagtacttaaggtcgtcggtccggcctacgttacgttcgtttacgggacggtacggaaccgaaagtcgacgagtataaccgaaacgtaagtcgnggtactcgactacg

SEQ ID NO: 389996 - DNA, 591 bp, Homo sapiens
  misc_feature: GZ8MTXP02GR83R.13.59.F04.1.454.CMB.2.raw
  modified_base (201)..(201): a, c, t, g, unknown or other
  modified_base (283)..(283): a, c, t, g, unknown or other
  modified_base (306)..(306): a, c, t, g, unknown or other
  modified_base (380)..(380): a, c, t, g, unknown or other
  modified_base (389)..(389): a, c, t, g, unknown or other
  modified_base (406)..(406): a, c, t, g, unknown or other
  modified_base (448)..(448): a, c, t, g, unknown or other
  modified_base (480)..(480): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagacgtcaccgttcacgttggccgggcgagtcacgacaattaacacttatttagcctggtatcagcagaagccgaggganacgtaccctaaattattgatctntgctggtccgtccgccttgacgtaaccgtccggggtcccagtcgtcggttcaggttggcgtgtatcgtagacanattcactcncacatccaacgaacctnaccaccagaaagtagtgttaaggtaagtttattactaggtanaacgtacctagttacgtcggttcggccccgtntaccgttagtttcccggggagggtaacgggtaccgtaaaggggtccacgtaaagggtaactaaacgtaaaacggaaaccgttacggtaaggtacgtcggtacgtaaacccg

SEQ ID NO: 389997 - DNA, 654 bp, Homo sapiens
  misc_feature: GZ8MTXP02JC7C9.13.59.F04.1.454.CMB.2.raw
  modified_base (231)..(231): a, c, t, g, unknown or other
  modified_base (286)..(286): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagacgtcaccgtcacgttggcccgggngtagtcacgactaattaactacttattagcctggtatcagcagacgccgaggganacgtacctaaattatgatctctgctgccgtccgtcctgcgtaaccgtccggggtacccagttccgttcggttacagggtggggtcggtggtatacgtaagggactaagtaacttaccactctcaaccactaccacccaaacctcgaccctaacctacgtaagtacgttaggttaaggttaaacgttttacttaacgtacgttaactaacggtacttaagtacggttacgggtccggtcccgtcgttacgttaacggtttcggggaacggggtaaccgggtaacggtaaacgggtcggtaaccgtaaggaacgttaaaccgaaaaccggttaacgtacggggtacgtccgttacggacccgttaacccg

SEQ ID NO: 389998 - DNA, 557 bp, Homo sapiens
  misc_feature: GZ8MTXP02J3I1X.13.59.F04.1.454.CMB.2.raw
  modified_base (227)..(227): a, c, t, g, unknown or other
  modified_base (274)..(274): a, c, t, g, unknown or other
  modified_base (407)..(407): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcgtggagacagacgtcaccgtcacgttggccggnagtcaacgacattaacacttattacgctgtatcagcagagcgagganacgtacctaattatgtatctctgctcgtccgtccgtcctcgaccgtaacggtcccggggtcctacgtcgtcggtacagggtgggcggtagatcgtagactagtatctactctacaccactaccaccgtaaccncacacgtagagtagttagtagtaattatacgtacgtactacgtacgttagtacggtcgtaccgtccgtacgttacgttacgggtacgggacggacggtacgacggtacgacgaagaacgtaacgaacgtacgtcgtcgactacgactacg

SEQ ID NO: 389999 - DNA, 564 bp, Homo sapiens
  misc_feature: GZ8MTXP02GZ4WE.13.59.F04.1.454.CMB.2.raw
  modified_base (191)..(191): a, c, t, g, unknown or other
  modified_base (202)..(202): a, c, t, g, unknown or other
  modified_base (231)..(231): a, c, t, g, unknown or other
  modified_base (274)..(274): a, c, t, g, unknown or other
  modified_base (282)..(282): a, c, t, g, unknown or other
  modified_base (295)..(295): a, c, t, g, unknown or other
  modified_base (341)..(341): a, c, t, g, unknown or other
  modified_base (558)..(558): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctcctgtctncatctctgganacagacgtcaccgtcacgttcggccgggnagtcacgactaattaacacttattacgcctggtatcagcaganccgagganacgtacctaattntgatctctgctgtccgtccgtcttcggctaccggtccggggtaccngtccgttcggttcagggtcggggcggttaggattcgtacgggactaagtacttcacttcctacgacctactccaacccgacctcgacctaccgagaagtagttaggttagtagtttatactggtacacgtactagtagtcggtcggtccctgtccgttacgtttcgggacggtacgggaccaggtcgacagtagtaacgaacgagttcggacgtacncgacac

SEQ ID NO: 390000 - DNA, 557 bp, Homo sapiens
  misc_feature: GZ8MTXP02H02CP.13.59.F04.1.454.CMB.2.raw
  modified_base (202)..(202): a, c, t, g, unknown or other
  modified_base (230)..(230): a, c, t, g, unknown or other
  modified_base (278)..(278): a, c, t, g, unknown or other
  modified_base (303)..(303): a, c, t, g, unknown or other
  modified_base (368)..(368): a, c, t, g, unknown or other
  modified_base (388)..(388): a, c, t, g, unknown or other
  modified_base (392)..(392): a, c, t, g, unknown or other
  modified_base (406)..(406): a, c, t, g, unknown or other
  modified_base (522)..(522): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtctccatcctcctgtctgcatctctggganacagagtcaccgtcacttcggaccgggntagcaacgacattaactacttattagctagtatcagcagagcaggganacgttacctaaattattgacttctntgctgccgtccgtacttgacgtacggtccggggtccctgtcgttcgtacgtggtgggcggtagtntccgtaggacagtacttccnctcncacacaccacaccncaccactagagtacgttagttagtaatttatacgtgtactacgtacttagtagtcggtacgccgtacgttacgttacggttacgggacggtacggtacgacggtcgacgtaacganaacgtaacgtaacgtacgtacgtacgtacgactac

SEQ ID NO: 390001 - DNA, 517 bp, Homo sapiens
  misc_feature: GZ8MTXP02FL059.13.59.F04.1.454.CMB.2.raw
  modified_base (225)..(225): a, c, t, g, unknown or other
  modified_base (379)..(379): a, c, t, g, unknown or other
  modified_base (411)..(411): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggnagtcacgacattaacacttatttagcctggtatcagacagaagccaggagagtccctaaaatattgatctctgctgcgtccgctgcaactcggggtccatctcgtcagtgggcgtggatcgtaggacagaattcactctcacatcaccaacctncaccctagagatgttagaagttattactgttnacgtactataggtcggtgccgtctcgtacttttcggcgggacggaccgaaaggttcgacgaggacttaacgaaaacggtaaaccttcggggtagtacgtacgacac

SEQ ID NO: 390002 - DNA, 559 bp, Homo sapiens
  misc_feature: GZ8MTXP02FL9O4.13.59.F04.1.454.CMB.2.raw
  modified_base (201)..(201): a, c, t, g, unknown or other
  modified_base (226)..(226): a, c, t, g, unknown or other
  modified_base (277)..(277): a, c, t, g, unknown or other
  modified_base (298)..(298): a, c, t, g, unknown or other
  modified_base (451)..(451): a, c, t, g, unknown or other
  modified_base (476)..(476): a, c, t, g, unknown or other
tcagtcacgtactacacgaccggtgctcgatttagtacacacacttaggtattgggggcagaagtctctctcagtcaggacacagcatggacatgagggtccctgctcagctcctgggactcctgctgctctggctcccagataccagatgtgacatccagatgacccagtctccatcctccctgtctgctatctctgganacagagtcaccgtcacttggccggngagtcacgacaattaacacttatttagcctggtatcagcagagccaggganagtccctaaattattgatctntgctgccgtccgcttgctaacggtccgggggtacccagtcgttcggtcaggtgggtcgggtggtatacgtagggacaagtaaacttctaactcctactacactaccaacccaactcgcctaccgagaagtatggttaggtaattatactagtnacgtacgtagtagtcggtcgccgtntacttcggtttcgggacggtacgggaaccaaggggtcacgagaacgtaacgaaaccgtaacgtggtcggactcggctaaaccg

SEQ ID NO: 390003 - DNA, 513 bp, Homo sapiens
  misc_feature: GZ8MTXP02F30W3.13.59.F04.1.454.CMB.2.raw
  modified_base (272)..(272): a, c, t, g, unknown or other
  modified_base (291)..(291): a, c, t, g, unknown or other
  modified_base (356)..(356): a, c, t, g, unknown or other
  modified_base (362)..(362): a, c, t, g, unknown or other
  modified_base (364)..(364): a, c, t, g, unknown or other
  modified_base (375)..(375): a, c, t, g, unknown or other
  modified_base (395)..(395): a, c, t, g, unknown or other
  modified_base (404)..(404): a, c, t, g, unknown or other
  modified_base (418)..(418): a, c, t, g, unknown or other
  modified_base (443)..(443): a, c, t, g, unknown or other
  modified_base (449)..(449): a, c, t, g, unknown or other
  modified_base (470)..(470): a, c, t, g, unknown or other
  modified_base (478)..(478): a, c, t, g, unknown or other
  modified_base (491)..(491): a, c, t, g, unknown or other
  modified_base (505)..(505): a, c, t, g, unknown or other
  modified_base (508)..(508): a, c, t, g, unknown or other
  modified_base (512)..(512): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccactcctcctgtctgctatctcttggagacagacgtcaccgtcacgttcgccgggacagtccaacgactaattaactaattagtttacgcttaggtancagacagaacgacgagganacgtacctaaattatgatctctgctgtctcgcttagcaacgtccggggtcccagtcctggtaccngtgggngngattcgagganataacttcacttcacactanacaccaccnggacctaccagganattgtaggtaacttatctatacagnttaagngtgcgctaacgtctggttcgnggacgganaacggcacgatanaagaacgacgacgngcncacnc

SEQ ID NO: 390004 - DNA, 523 bp, Homo sapiens
  misc_feature: GZ8MTXP02GQU6L.13.59.F04.1.454.CMB.2.raw
  modified_base (226)..(226): a, c, t, g, unknown or other
  modified_base (267)..(267): a, c, t, g, unknown or other
  modified_base (276)..(276): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccggnagtcacgacattaacacttattagcctggtatcagcagaanccgaggganagtaccctaaatattgatctctgctgctccgccttgacaacgtccggggtccagtcctcggttcaggtggcgggtgattcgtaggactagtactcactctcacatccacgaacctcgaccacctagacgatgttaggtaatttagtactgtacagtactagtagtggtcgccgtctacgtacgtttcggacggtacggaccgacggtgacgagtaacaacgaaaacgacttagcggactcgactacc

SEQ ID NO: 390005 - DNA, 557 bp, Homo sapiens
  misc_feature: GZ8MTXP02FQKRX.13.59.F04.1.454.CMB.2.raw
  modified_base (201)..(201): a, c, t, g, unknown or other
  modified_base (449)..(449): a, c, t, g, unknown or other
  modified_base (496)..(496): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagatcaccgtcacttcggccgggcgagtcacgacattaacacttattacgcctggtatcagcaagaagccgagggacgagtaccctaaattactgatctactgctgccgtccgcttgcaaccggtccggggtcccatccgttcggttcgaggtggcgggtgagtcgtaggacaagtattcactctacacactcaacccacctcgacccacctagaactagttggttaagggtaatttacttacgtntacgaacgtaccttagtagtcggtcggccgtctacgtacgtttcggngggacggtaccgaggtcgaccgaagactaacgaaacgtaacgtcggtacgacgtcgacaac

SEQ ID NO: 390006 - DNA, 501 bp, Homo sapiens
  misc_feature: GZ8MTXP02HRBQN.13.59.F04.1.454.CMB.2.raw
  modified_base (441)..(441): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttaagcctggtatcagcagaagccagggagaggtcccctaaattattgatctctgctgctccgccttgcaacgtcggggtccatctcggttcagtggcggtgatctaggacagtaatcactctcaccatctaccaacctgacaccctagaagatcgttagaagtttattactgtcagacctatagtgtggccntcatttcggcggtagggaccaaggtcgactaggataacgaaacgaactgtgactgctacc

SEQ ID NO: 390007 - DNA, 613 bp, Homo sapiens
  misc_feature: GZ8MTXP02I4LI1.13.59.F04.1.454.CMB.2.raw
  modified_base (278)..(278): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttggagacagagtcaccgtcacttcggccgggcgagtcacgacattaacacttattagcctggtatcagcagaagccagganagtaccctaaattatgatctctgctgcgtccgcctgcaacgtcggggtcccagtcttcggtcagtgggcggtggatcgtaggacagtaaattcactctacaccactccaaccaaccctgaccctaccctagaacgattaggttaggaaacgtttattaccgtgtaccgtaacgtaccttaagtaacggttgggtccggtacccgtacgttccgttaaacggtttttccgggggaccggggtaacgggggtaaaccccgtaaacggggttcgaaccgagtaaaccgttaacgaaaaaccggtaacgttccgggttaaggcttacggacctaacccg

SEQ ID NO: 390008 - DNA, 543 bp, Homo sapiens
  misc_feature: GZ8MTXP02JZYUJ.13.59.F04.1.454.CMB.2.raw
  modified_base (203)..(203): a, c, t, g, unknown or other
  modified_base (230)..(230): a, c, t, g, unknown or other
  modified_base (281)..(281): a, c, t, g, unknown or other
  modified_base (350)..(350): a, c, t, g, unknown or other
  modified_base (381)..(381): a, c, t, g, unknown or other
tcagtcacgtactacacgaccggtgctcgatttagtacacacacttagggattgggggcaggaagtctctctcagtcaggacacagcatggacatgagggtccctgctcagctcctgggactcctgctgctctggctcccagataccagatgtgacatccagatcgacccagtctccatcctccctgtctgcattctctgganacagacgtcaccgtcacgttggccggnagtcacgacattaacacttattacgcctggtactcagcacgaagccagganagtacctaaattatgatctctgctgcgtaccgtccttgctacgtccggggtccatcgtcgtcaggtggnggtgatcgtagacagtactcactctcaactntaccaccactcgaccacctagaagtatgttagaattgttacgtaggttacagtaccgttaatggtggtccgcccgtacgtacttacgtttcgggacgggtacgggtaaaccaagggtcgacgtagaacgtcgaaaacgtcgtacgtggacctcggactaccg

SEQ ID NO: 390009 - DNA, 574 bp, Homo sapiens
  misc_feature: GZ8MTXP02I6K78.13.59.F04.1.454.CMB.2.raw
  modified_base (365)..(365): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtccaccgtcacgttggccgggcgagtccaacgacattaacacttattagcctggtatcagacagaacgccgaagggacgagtacccgtaaattacgttagtatactctgctgctcgctgcacgtcggggccatctcgtcagtggcgtggatcgaganagtactcactctacacctactacacctaacctacgacaccctagaacgtattaggttaggtaaacggtttatttacctacggttactaacgtaccgttaagtaggttcggccggtacccggtcttaaccgtacgtttttccggggacggtacgggtaacgaaacggttcgacgagactaacgaaacgtaacgtgtacgctcgactaacc

SEQ ID NO: 390010 - DNA, 496 bp, Homo sapiens
  misc_feature: GZ8MTXP02JBW73.13.59.F04.1.454.CMB.2.raw
  modified_base (383)..(383): a, c, t, g, unknown or other
  modified_base (426)..(426): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtaccctaaattatagatctctgctgcgtccgcttgcacgtcggggtccatctcgtcagtggcgtgatctaggacagaatcactctcacatcacactgcacctgaanactgttagaagttatactgtacagacctagtagtgtcggcctntactacgtttcggcggaacggacaaaggtcgacgagacaagaaacgaagtcgtaggctacggactaaccg

SEQ ID NO: 390011 - DNA, 552 bp, Homo sapiens
  misc_feature: GZ8MTXP02F0Y1J.13.59.F04.1.454.CMB.2.raw
  modified_base (201)..(201): a, c, t, g, unknown or other
  modified_base (230)..(230): a, c, t, g, unknown or other
  modified_base (286)..(286): a, c, t, g, unknown or other
  modified_base (474)..(474): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtccaccgtcacgttggcccgggngagtccaacgactaattaactacttattagcctggtatcagacagaagccaggganagtacctaaattatgatctctgctgtcgtccgtcctgacaacgtccggggtcccagttcgtcggttcaggtgggcgtggactcgtagactagtattcactctacacactaccaaccgacctgaccacctagaacgtatagttaggtaatttattacgtagtacacgtacgtagtaggtgtccgccgtntcttacggttcgggacggtacggacgtaaggtcgacaagtaacaacgtaaaacgtacgtcgcggactacgacctaacg

SEQ ID NO: 390012 - DNA, 502 bp, Homo sapiens
  misc_feature: GZ8MTXP02JR4VW.13.59.F04.1.454.CMB.2.raw
  modified_base (201)..(201): a, c, t, g, unknown or other
  modified_base (226)..(226): a, c, t, g, unknown or other
  modified_base (389)..(389): a, c, t, g, unknown or other
  modified_base (474)..(474): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccagggagagtccctaaattattgatctctgctgcgtcgccttgcaacgtcggggtcccatctcggttcagtggcggtggtatgtaggacagattcactctcacatcacacctgacaccctnaagtatgttaggaagtttataactgtacagacctatagttggacgccgtctctacgtttcggcggacggaccaaggtcgacaganaacgaaaccgaagtgtgcgtagctaacc

SEQ ID NO: 390013 - DNA, 518 bp, Homo sapiens
  misc_feature: GZ8MTXP02FYH14.13.59.F04.1.454.CMB.2.raw
  modified_base (201)..(201): a, c, t, g, unknown or other
  modified_base (206)..(206): a, c, t, g, unknown or other
  modified_base (295)..(295): a, c, t, g, unknown or other
  modified_base (338)..(338): a, c, t, g, unknown or other
  modified_base (447)..(447): a, c, t, g, unknown or other
  modified_base (481)..(481): a, c, t, g, unknown or other
  modified_base (509)..(509): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagngtcaccgtcacttgccgggcagtcacgacattaacacttattagcctggtatcagcagaagccaggagagtccctaaattattgatctntgctgccgtcgccttgcaacgtcggggtcccagtctcgttacnggtgggcgtggatcgtagacagattcactctcaacatacaccacctcgacaccctagaagtatgttagtaaagttattacctaggtacacgtactaatggtggcggccncttcgtagtttcggcgggtacggaccaaagggtnacgagataacaaacggactacggcgtcncgactaccg

SEQ ID NO: 390014 - DNA, 497 bp, Homo sapiens
  misc_feature: GZ8MTXP02FJSCX.13.59.F04.1.454.CMB.2.raw
  modified_base (420)..(420): a, c, t, g, unknown or other
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacactatttagcctggtatcagcagaagccagggagagtcccctaaattattgatctctgctgcgtccgcttgcaactcgggggtcccatctcggttcagtggcggtggatctagacagaattcactctcacatcacccaaacctcgcacccctagaagaatgttggaagttattaactgtnagacctatagtgtggccgctcatttcggcggtagggaccaaaggtcgcgagatcaaacgaaactgtggctggcaacc

SEQ ID NO: 390015 - DNA, 602 bp, Homo sapiens
  misc_feature: GZ8MTXP02GG805.13.59.F04.1.454.CMB.2.raw
  modified_base (233)..(233): a, c, t, g, unknown or other
  modified_base (363)..(363): a, c, t, g, unknown or other
tcagtcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctnacagtgacctgcaccgtctctgggctttcactcaatagaagtacagtgtgtatgagttggattcgtcagtccccgagggaagccctgggagtggcttgcacgcattgattgggatgatgatacaaaaatnttaacaacacatctatagaagaccaggctacaccatctaccgaaggacatcttacacgtagacctaaagtcggtaccttaaggaatcgaacctaaacgttcggacccttggtacggaacacgacggtactaccttaatttaacgttggtactaccaactaagttaaccaaaaggtactatttactaacgtaacggttggtacggtacggttacgtcgggggaccgaacgggggttcccg

SEQ ID NO: 390016 - DNA, 621 bp, Homo sapiens
  misc_feature: GZ8MTXP02I9Q9T.13.59.F04.1.454.CMB.2.raw
  modified_base (202)..(202): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcattctcttgganacagagtccaccgtcacgttcggcccgggcgagtccaacgacaattaactacttattagcctggtatcagcagacgccgagggacgagtaccctaaattattgatctctgctgtccgtccgtcttgacgtaaccgtccggggtccctacgtcgtcggttcgaggtgggcggtaggtactacgtaaggactaaggtaacttaccacttcctacctaacctactaccaacccacctcgacctacccgtagaacgtagttcggttaaggttaagtttacttacgtagttacgtacgtaaccttagtacggttaggtccgtccgtacgttcgttaacggtttcgggacggtacgggtaccgaagggttcgaacgtcgaagtaaccgtaaaaccggaagttcggtacgacgtcggtacctaccg

SEQ ID NO: 390017 - DNA, 576 bp, Homo sapiens
  misc_feature: GZ8MTXP02IIIDZ.13.59.F04.1.454.CMB.2.raw
  modified_base (201)..(201): a, c, t, g, unknown or other
  modified_base (410)..(410): a, c, t, g, unknown or other
  modified_base (494)..(494): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcacgtcacttggccgggcgagtcacgacattaaacacttattagcctggtatcagacagaagccgagggagagtaccctaaattattgatctctgctgcgtccgccttgctaacgtccggggtcccagtcgtcgttcgagtgggcggtgatcgtaggacaagtatcatcctacaccactccaaccaacctcgacctacccgngaaagacttggttagtaagtttaattacttgtacacgtaacctagtaggtcggtcggcccgtctaccgttggttttaccggggnggggaacggacggaccgtaagggtcgacgtaacggaacgttaacgaaaaacgtaccgtaaggttcggacgttacggaacccg

SEQ ID NO: 390018 - DNA, 565 bp, Homo sapiens
  misc_feature: GZ8MTXP02IPHPX.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttcggccgggcagtcacgacattaactacttattacgcctggtatcagcagacgccgagggagacgtaccctaaatattgatctctgctgcgtccgtctagctaacgtccggggtccatcgtcgtcgagtcggggcgtggagtcgtacggacagaacttcactctcacactaccaacctacctcgccaacccgtagaagtagtacgttaggtaagtttacttacgtagtaccgacgtaccgtatacggttaggtcggtcccgtcgtccgttacgtttcggacgggacgggtaaccgaaggttcgactaagacgtaacgaaacgtaacgtcgtacggctacgactacc

SEQ ID NO: 390019 - DNA, 566 bp, Homo sapiens
  misc_feature: GZ8MTXP02H09TX.13.59.F04.1.454.CMB.2.raw
  modified_base (201)..(201): a, c, t, g, unknown or other
  modified_base (227)..(227): a, c, t, g, unknown or other
  modified_base (355)..(355): a, c, t, g, unknown or other
  modified_base (406)..(406): a, c, t, g, unknown or other
  modified_base (466)..(466): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccatatgtgacatccagatgacccagtctccatccctcctgtctgcatctcttgganacagagtccaccgtcacttgccgggnagtcaacgatattaacacttattagcctggtatcagcagaagccgaggagacgtacctaaattatgatctctgctgccgtccgtccgttgacaaccggtccggggtaccctagtccgttcggttacgnggttcggggcgggtggactacgtaggacagtaacttacactctaccacacnccaacccaacctcaccacccgtagaagagttagttaggtactttatacgtgtaaaaaacncgtaacgtagtgtcggtcgccgtcgttacgtacggttcgggacgggtacggacgtaggacgacgagtacgaacgaaacgtacgtcggacgtacacgacac

SEQ ID NO: 390020 - DNA, 569 bp, Homo sapiens
  misc_feature: GZ8MTXP02GN6HT.13.59.F04.1.454.CMB.2.raw
  modified_base (200)..(200): a, c, t, g, unknown or other
  modified_base (227)..(227): a, c, t, g, unknown or other
  modified_base (380)..(380): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtcacttggcccgggnagtcacgacattaacacttattagcctggtatcagtcagagccaggagacgtccctaaatattgatactctgctgcgtccgtacctcgcaacgtcggggtccatctacgttcaggtggccggtggactcgtaggacagaattcatctcaccanccaccacctgacaccctagacgtaatggttacgagtttatacgttgtactacgactacttaaggtcggttcgaccggtcttacgttacgtttcgggaccgggtacgggtaacccgaggttacgaccgaaggtaacttaacgaaaaccggtaaccgtttggttaacggccgttacggaccgttaaccccg

SEQ ID NO: 390021 - DNA, 652 bp, Homo sapiens
  misc_feature: GZ8MTXP02JBC5X.13.59.F04.1.454.CMB.2.raw
  modified_base (228)..(228): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttggagacagacgtcaccgtcacttggccggngagtcacgactattaacacttattagcctggtatcagcagagccgagggagacgtccctaaattacttagatctctgtctgtcccgtccgtccttcgactaaccggtccgggggttaccccagttccgttcggttacccgtaggtcgggggtcgggtacgggtaacgtacgtaggggtaaccaaggttaacttaccgaccttactcccgaaacctactaccctaaccctaacccgtcgtacccaaccctaagaacgtagttaggtttaagggtaaacgtttattaacgttacgtaacctaacggtaaccttagttaaggtcggttccggccgtacgtacgtaacgttttccggggacggtacggggacctaaggtcgacgtacgaactaaccgaaaacgtaacgtggtcgactacggctaaccg

SEQ ID NO: 390022 - DNA, 603 bp, Homo sapiens
  misc_feature: GZ8MTXP02I1FAG.13.59.F04.1.454.CMB.2.raw
  modified_base (201)..(201): a, c, t, g, unknown or other
  modified_base (215)..(215): a, c, t, g, unknown or other
  modified_base (226)..(226): a, c, t, g, unknown or other
  modified_base (277)..(277): a, c, t, g, unknown or other
  modified_base (292)..(292): a, c, t, g, unknown or other
  modified_base (442)..(442): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggnagtcacgacattaacacttattacgcctggtatcagcagaagccgaggganacgtaccctaaattntgatctctgctgccgtccgtcctgacgtaaccggtccggggtccctagtccgttcggttccgaggtggggtcggtaggattccgtaaggaacaggtaacttccacttcctacaccgtatcccaaccctacgtcacccaccctagaacgtntaggttagtaaacgtttattaccgtgtaccaacgtaccttagtacggtaggtcgtcccgagttcgttacggtttacgggacggtaccgggtaccgtaaagggtcgaaccgtagaacgttaaccgaaaacggttacgttaggtacggcctacgaccgtaacc

SEQ ID NO: 390023 - DNA, 570 bp, Homo sapiens
  misc_feature: GZ8MTXP02GTLTP.13.59.F04.1.454.CMB.2.raw
  modified_base (201)..(201): a, c, t, g, unknown or other
  modified_base (226)..(226): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggnagtcacgacattaacacttattagcctggtatcagcagaagccgagggagagtaccctaaattattgatctctgctgcgtccgctgcaacgtcggggtccatcgtcggttcgaggtcgggacggtggatcgtaggacaagtaacttcactctaccacctactacccaacccaccctcgacccacccgtagaaacgtagttagttaaggtaacgtttaattacgttagtacacgtaccttagtacggtcggtcggcccgtctacgttacgtttcgggacgggacggaccgtaaggtcgacgacgtacgaacgaaacgtaacgtcggtacgtacgtcgactaaccg

SEQ ID NO: 390024 - DNA, 584 bp, Homo sapiens
  misc_feature: GZ8MTXP02JTGD5.13.59.F04.1.454.CMB.2.raw
  modified_base (131)..(131): a, c, t, g, unknown or other
  modified_base (180)..(180): a, c, t, g, unknown or other
  modified_base (199)..(199): a, c, t, g, unknown or other
  modified_base (289)..(289): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctntggctcccagataccagatgtgacatccagatgacccagtctccatccncctgtctgcatctctgganacagagtcaccgtcacgttgccgggacagtcacgacattaacattattacgctggtatcagcagaagccgagggagacgtacctaaattnttagatctctgctgtcgtccgtccgttgacgtaaccggtcgggggtcccagttccgttcgttccgagggtcggcgggttgaagttccgaagggactaggaacttcccactccacaccactacccgacctactaccgacctaaccgtagtaagtacgttaggttaacggtaacttcttacgtacgtacgtacgtacgtaggtacggtcggtccgtaccgtacgttcgttacggttacgggacggacggtacgagcgacgacgtacgtaacgaaacgtcgcgtacgtcgtacgacac

SEQ ID NO: 390025 - DNA, 638 bp, Homo sapiens
  misc_feature: GZ8MTXP02IKJA3.13.59.F04.1.454.CMB.2.raw
  modified_base (226)..(226): a, c, t, g, unknown or other
  modified_base (288)..(288): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatcagcagaagccaggagagtccctaaattntagatctctgtctcgccgtccgccctgtccaacgtccggggtcccctagtcgtcggttcgtagtcggggcggttagggagtccgttaagggacgaagtaacttactacctacctcccaaccaccttccaaccctaaaacccccgtgtacccacccccttaggaaagtaagttaggtttagggttaaagttttaaacttcttacgtaccgagttaaccctaagttcggtaggttccggcccgtactcccgttaggttttaccgggtacggggacggtaacccggaacgggggttagaccgtaagaacgtaacgtaaaaccggaaccggttcggtagtccggcttaccaccg

SEQ ID NO: 390026 - DNA, 655 bp, Homo sapiens
  misc_feature: GZ8MTXP02GN2RI.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcattctcgttggagacagagtccacccgtcacgttcggccgggcgagtcaacgaactacttaaacctactttattacgcctaggtatcagcaggaacgccgaagggagacgtacccttaaattattgatctctgtcgtgccgtccgtcgttcgacgtaacggtccggggtcctagtccgtcggttcgaggtggggcggtggtacgtacgtaacgggtacacgtaacttaccacttccctaccaacctactacccaaccctaaccctcgtaacccaccgtagaagtagttggttaaggtaagtttactacgttacgtacgtacgtacttaggtacggttcgggtaccggtcccgtgtttaccgttacgggttttccggggacgggggtaacgggtaaccgtaaacgggtgtaaaccgagtaaccgtaacgaaaacggacgttaggacggtctacggtacctaaccg

SEQ ID NO: 390027 - DNA, 523 bp, Homo sapiens
  misc_feature: GZ8MTXP02FNZSZ.13.59.F04.1.454.CMB.2.raw
  modified_base (277)..(277): a, c, t, g, unknown or other
  modified_base (299)..(299): a, c, t, g, unknown or other
  modified_base (367)..(367): a, c, t, g, unknown or other
  modified_base (513)..(513): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcagtcacgacattaacacttattagcctggtatcagcagaacgccaggganagtaccctaaattattgatctntgctgcgtccgcttgcaacgtcggggtcccatctcggttcagtggcgtggatcgtagacagaacttcnctctcaaccactcaacccaacctgccctacccgagaagtatggttaggtaattattaactcgtataacgtacctatacggttggcgtccgctctacgtttcggcggacgggacctaaagggcgacagacaacgaaacgtagtcggngacacgacac

SEQ ID NO: 390028 - DNA, 582 bp, Homo sapiens
  misc_feature: GZ8MTXP02IBYL9.13.59.F04.1.454.CMB.2.raw
  modified_base (201)..(201): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcgagtcaacgacattaacacttattagcctggtatcagcagaagccgagggagagtccctaaattattgatctctgctgcgtccgccttgcaacgtccggggtcccagtccgtcggttcaggtgggcgggtggagtcgttagacagtaaattcactctcacactcaccaacctgaccaccctagaagtattggtttaggaaaggttttacttacgtagtactaggtaaccttaagtaggttggttccggcccgtacttccgtacgttttccgggacggggtaacgggaacccgtaaagggtcgaccgaagtaacgaacgtaaaaccgaacgttgtacggtcgtacggactaacccg

SEQ ID NO: 390029 - DNA, 578 bp, Homo sapiens
  misc_feature: GZ8MTXP02I8A3M.13.59.F04.1.454.CMB.2.raw
  modified_base (203)..(203): a, c, t, g, unknown or other
  modified_base (218)..(218): a, c, t, g, unknown or other
  modified_base (280)..(280): a, c, t, g, unknown or other
  modified_base (294)..(294): a, c, t, g, unknown or other
  modified_base (301)..(301): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttgganacagacgtcaccgtnacgttggccggcagtcacgactattaacacttattagcctggtatcagcagaagccgagganacgtacctaaattntgatctntgctcgccgtccgtctgacgtacggtccggggtcctacgtcgtcggtcaggtgggtcggtggtactacgtagacagtactcactcacacactccaaccactcgaccacctagaagtacgttagttaggtaattattacgtagtaactagtacctagtacggtggtaccgtccgtcgtcgtttacggtttccgggacggggtacgggaaaccgtaagggtcgaacgtaacgtaactaaacgaaaacgtacgtaggtacggacttacggacctaacccg

SEQ ID NO: 390030 - DNA, 588 bp, Homo sapiens
  misc_feature: GZ8MTXP02JSNJ2.13.59.F04.1.454.CMB.2.raw
  modified_base (199)..(199): a, c, t, g, unknown or other
  modified_base (224)..(224): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctcatcctcctgtctgcatctcttgganacagagtcaccgtcacttgccgggnagtcacgacattaaacacttattagcctggtatcagcagagccgagggagagtaccctaaattatgatctctgctgcgtccgtcttcgcaacgtccggggtccccagtcgtcggttcgaggtcggcggtggaattcgaaggacagtaaacttcaactctcaaccatccaacccaaccgtgacctacccgtagacgtagtggttaaggtagtttataacttggtacaactaccgtaattacggtcgggtcggtcccccggttcgttaccgtttacggtttccggggacgggtaacgggaacggtaaagggtcgaacgtaagaacgtaaacgaaacggtacgtacggtacggtcgtacgaactacc

SEQ ID NO: 390031 - DNA, 498 bp, Homo sapiens
  misc_feature: GZ8MTXP02FFV9T.13.59.F04.1.454.CMB.2.raw
  modified_base (205)..(205): a, c, t, g, unknown or other
  modified_base (216)..(216): a, c, t, g, unknown or other
  modified_base (271)..(271): a, c, t, g, unknown or other
  modified_base (284)..(284): a, c, t, g, unknown or other
  modified_base (338)..(338): a, c, t, g, unknown or other
  modified_base (410)..(410): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccgtccctgtctgcatctcttggagacngagtcaccgtnacttgccgggcagtcagacattacactattagctggatcagcagaagccaggganagtccctaaattnttgatctctgctagcgtcgcttgcaatcggggtcccatctacgtcagttgcggnggatctaggacagaattacactctcacatcacaacctacacacccacagaatgtagtagttattaatgttanacgactatagtcgcgcgtcgtctacgttcggtacggacggacgacgtacgacgagacgaacgaaacgtaacgtacgtgcgacgacacg

SEQ ID NO: 390032 - DNA, 495 bp, Homo sapiens
  misc_feature: GZ8MTXP02FHLRA.13.59.F04.1.454.CMB.2.raw
  modified_base (214)..(214): a, c, t, g, unknown or other
  modified_base (225)..(225): a, c, t, g, unknown or other
  modified_base (470)..(470): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtnacttgccgggnagtcacgacattaacacttatttagcctggtatcagcagaagccagggagagtccctaaattattgatctctagctgcgtccgccttgcaacgtcggggtcccatctcggtcaggtgcggtgatctagacagatcactctcaccatcacccaactcgacaccctagactatgttagagttatactagtcagacctatagtggtggcccgctcacgttttcggcggtacggaccaaggtcgcaganaacgaaacgaactcgtgcacgcacc

SEQ ID NO: 390033 - DNA, 579 bp, Homo sapiens
  misc_feature: GZ8MTXP02IFPM3.13.59.F04.1.454.CMB.2.raw
  modified_base (203)..(203): a, c, t, g, unknown or other
  modified_base (386)..(386): a, c, t, g, unknown or other
  modified_base (559)..(559): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatcttcttgganacagacgtccaccgtcacttggccgggcgagtcaacgacattaactacttattacgctggtatcagcgaagaagccgagggacacgttaccctaaattatgatctctgctcgcgtcctcttcgactaaccgtcggggtcctagtctcggttcaggtggcggtggactcgtagacagtaacttnactctacaacataccaacacctgaccaccgtagaatacgttagttaggtaatttaagttatacgtacgtacgtaacttagttacggtggtccgtccgtcttacgttacgtttcggggacggtaacggtacgaaacgggttcacgtaagacgtaaaccgaaacggtaacgttgnggtaccctaggacctaaccg

SEQ ID NO: 390034 - DNA, 532 bp, Homo sapiens
  misc_feature: GZ8MTXP02GD9FE.13.59.F04.1.454.CMB.2.raw
  modified_base (215)..(215): a, c, t, g, unknown or other
  modified_base (340)..(340): a, c, t, g, unknown or other
  modified_base (346)..(346): a, c, t, g, unknown or other
  modified_base (358)..(358): a, c, t, g, unknown or other
  modified_base (385)..(385): a, c, t, g, unknown or other
  modified_base (387)..(387): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacgttcgccggacgagtcacgacattaactacttatttagcctggtatcagcagagcgaggagacgtacctaattatgatctctgctgccgtccgctgcaacgtcggggcctatcgtcgttacgnggtggngtgatcgtaganatactcactctacacactaccaccacncncaccgagagtagtagtaggtattatacgtacgtactacgtacgtagtggtcggtcgtccgtactcgttacggttcgggcgggtacggtacggtagtacgacgtacgtaacaacgaaacgtcgtacggtacgacgtacgacctacg

SEQ ID NO: 390035 - DNA, 630 bp, Homo sapiens
  misc_feature: GZ8MTXP02G5QFZ.13.59.F04.1.454.CMB.2.raw
  modified_base (202)..(202): a, c, t, g, unknown or other
  modified_base (229)..(229): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttgganacagacgtcaccgtcacttggccgggnagtcacgacattaacacttattagcctggtatcagcaagagccgtagggacgagttaccctaaattattgatctcgtgctggcgtccgtactgtcgaaacggtccggggtaccacgttccgtacggttccgaggtcggggtcgggtggattacgtagggacaacgtaaacttccaacttccgtactaaccacgttacccaacctacccgtacacccacccgtaggaaacgtagttaggttaaggtaacgtttactaccgtgggtaactacgtaccgttagtacggtcggggttcgcccgttctacgttacggtttaccggggacggggtacgggtaaaccgtagggggtcacggtacgtaagtaaccgaaaacgtaacgtggtccggactcggacctaacg

SEQ ID NO: 390036 - DNA, 584 bp, Homo sapiens
  misc_feature: GZ8MTXP02GXA91.13.59.F04.1.454.CMB.2.raw
  modified_base (204)..(204): a, c, t, g, unknown or other
  modified_base (234)..(234): a, c, t, g, unknown or other
  modified_base (311)..(311): a, c, t, g, unknown or other
  modified_base (361)..(361): a, c, t, g, unknown or other
  modified_base (433)..(433): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctcctgtctgcattctcgttgganacagtacgtcaccgtcacgttcggccgggngacgtcacgaactaacttaactacttattacgccgtggtatcagacaagacgcgaagggacacgttaccttaaattnttagactctctgtctgccgtccgtccgtgcgtaaccggtccggggtaccncgtcgtcgttcgaggtcgggcggtagatcgaggacagtactcactcacactacgaccacactcgaccacgtnaagtctagttacggtatttataccgtgtacaccgtattagtcggtcggtccgcctcgttacggtacggtttacgggacggttacgggaccgaaggtcgaacgagttaacgaaacgtaaacgtacgttcgacggtactacggacctaaccgg

SEQ ID NO: 390037 - DNA, 555 bp, Homo sapiens
  misc_feature: GZ8MTXP02JZF3M.13.59.F04.1.454.CMB.2.raw
  modified_base (202)..(202): a, c, t, g, unknown or other
  modified_base (278)..(278): a, c, t, g, unknown or other
  modified_base (293)..(293): a, c, t, g, unknown or other
  modified_base (339)..(339): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttgganacagacgtcaccgtcacttggccgggcagtcacgacattaacacttattagcctggtatcagcagacgccgagganacgtaccctaaattntgatctctgctgcgtaccgcttgcaacgtccggggtccatctcgtnagtggcggtgatcgtagactagtactcactctacacataccaccctaacctgaccctacccgtagaacgattggttagtaacggtttattacgtgtacataccgttagtaggtcggttcggcccgtactcgttacgtttcgggacggtacgggtaccgaggtcgacaacgtataacgtaaacgtaacgtacggttcggaccttacggactaaaccg

SEQ ID NO: 390038 - DNA, 518 bp, Homo sapiens
  misc_feature: GZ8MTXP02FJ91G.13.59.F04.1.454.CMB.2.raw
  modified_base (226)..(226): a, c, t, g, unknown or other
  modified_base (419)..(419): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaatattgatctctgctgcgtccgcttgcaagtcggggtccatctcggttcagtggcggtggatcgtaggacagaattcactctcaccatcaccaacctcgcaccctgaagatgttggtaaagttattactggtanaacgtacctagtagtggtaggcccgctctagttttcggcgggacgggaccgaagggtcgacgagaataacgaaaacgaacgtcgtggctcggctaaccc

SEQ ID NO: 390039 - DNA, 563 bp, Homo sapiens
  misc_feature: GZ8MTXP02IDGS8.13.59.F04.1.454.CMB.2.raw
  modified_base (201)..(201): a, c, t, g, unknown or other
  modified_base (365)..(365): a, c, t, g, unknown or other
  modified_base (424)..(424): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagagccaggagagtaccctaaattattgatctctgctgcgtccgccttgcaacgtcggggtcccatctcggttcagtgggcgtggatctaggacagaattcanctcaccatccaccaacctgaccacccgtagaacgtattagttagggaattttatacgtntacgacgacctagtagtcgggtcgcccgtcgttctaacgttttccggggacggtaacgggaacccgtaaaagttcggacacggaaattaaccgaaaaacgtaacctttagggaacggtccgttaacggacctaaacccg

SEQ ID NO: 390040 - DNA, 661 bp, Homo sapiens
  misc_feature: GZ8MTXP02GQ8H5.13.59.F04.1.454.CMB.2.raw
  modified_base (242)..(242): a, c, t, g, unknown or other
tcagtcacgtactacacgaccggtgctcgatttagtacacacacttagggattgggggcagaagtctctctcagtcaggacacagcatggacatgagggtccctgctcatctcctgggactcctgctgctctggctcccagataccagatgtgacatccagatcgacccagtcctccactccctccctgtctgctattcctcgttaggagtacaggacgtccaccgtcacgttcggccgggngagtccacgacaattaacactttattacgacctggtactcagacagaacgccgagggagacgttacccttaaatattagtactctacgtcgtacgtcggtccgtaccgtccgtacgtaccgtaaccggtccggggtacccctagtccgttcggtaccgtagggtcggggacggtaggtactacgtaggactaagtaacttcgactacacaaccactaccaacccacctcgaccacctagaatagttaggttagttaacgtttaattacgtacgtacgacgtaaccgttagtacggtacggtccggtccgtacgtcgttacggtttcgggacgggtacggaacggtaacgggtcggacctaaggttaaccgtaaacgaaaccggttaacgtacggttacggactaccggtacctaacccg

SEQ ID NO: 390041 - DNA, 690 bp, Homo sapiens
  misc_feature: GZ8MTXP02HQZFR.13.59.F04.1.454.CMB.2.raw
  modified_base (324)..(324): a, c, t, g, unknown or other
  modified_base (375)..(375): a, c, t, g, unknown or other
  modified_base (391)..(391): a, c, t, g, unknown or other
tcagtcacgtactacacgaccggtgctcgatttagtacacacacttagggattgggggcagaagtctctctcagtcaggacacagcatggacatgagggtccctgctcagctcctgggacccttttttgctgctctggctcccagataccagatgtgacatccagatcgacccagtcctccactccctccctgtctgcatctcttggagacagacgcctaccgtcacgttcggccgggacgacgtccacgtaataattaactactttattacgccgttaggtactcagacaagacgaccgtagggagtacgttacctaaagttnttagatctctgctcgtccgccgttcctagccgtaccggtcccggggtaccngttccgttaggtccgngggtcgggtcggtgactacgtaggacagtactcactctacacactccgaacctaacgtcaccctaccgtagaaacgtgttaggttaggtaaacttttacgttacttacggtaactaacgttaaccgtaggttaacggggttcgggtaacccgtccccgtttagttacccgggtttcggtttacccggggtacgggggaaacccggtttaaaccggagggttcccgggaaacttaacgaaccgttaaaacggaaaacccgtaggttcccggaaggtcccttaaacggcgtttaaaccccg

SEQ ID NO: 390042 - DNA, 632 bp, Homo sapiens
  misc_feature: GZ8MTXP02HMY4F.13.59.F04.1.454.CMB.2.raw
  modified_base (203)..(203): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcgttgganacagacgtcaccgtcacttggccgggcagtcacgacattaacacttattagcctggtatcgagcagaagccgagggagacgttaccctaaattattagatctctacgctcgcgtccgtccttcggcaacggtccgggggtacccagttccgtcggttcacggtgggccgggtggactcgtagacagtattcactctcactatccacccactcgacctacctagaacgtagttacggttagggtaagtttacttacgttacgtacgtaaccgtaacttaggttaacggtcgggttacggtccccgtacgttacccgttacggttttacccgggggcgggttaaacggggacccgtaagggttcggaacgtacggtaaacgttaaccgaaaacggtacgttcggtaacgggtccgttacggacttaacccg

SEQ ID NO: 390043 - DNA, 619 bp, Homo sapiens
  misc_feature: GZ8MTXP02FXYIO.13.59.F04.1.454.CMB.2.raw
  modified_base (184)..(184): a, c, t, g, unknown or other
  modified_base (190)..(190): a, c, t, g, unknown or other
  modified_base (267)..(267): a, c, t, g, unknown or other
  modified_base (283)..(283): a, c, t, g, unknown or other
  modified_base (299)..(299): a, c, t, g, unknown or other
  modified_base (303)..(303): a, c, t, g, unknown or other
  modified_base (364)..(364): a, c, t, g, unknown or other
tcagtcacgtactacacgaccggtgctcgattagtacacacacttagggattgggggtcagaagtctctctcagtcaggacacagcatggacatgagggtccctgctcagctcctgggactcctgctgctctggctcccagataccagatgtgacatccagatgaccccatctccatcctcctntctgcntctcttggacgacagacgtcaccgtcacgttcggccgggcgacgtcacgaacattaacacttatttaagcctggtancagcagacgcaggganagtaccctaaactttntgtntctctcgctcgtccgtccgtcgtcgacgtacccggtccggggtcctcgtccgtcggtacgngggtcggtcggtagtactacgtagacaacgtaacttctactacctacaacctactacccaacccaccgtacgaccgtaccgtacgtacgtagttagttagtaactttacgttacgtacgtaccgtacgttaccgttaggtacggttcggtccggtcccgtcgttacgttacggttacgggaccggtaacggaacgtacggtacgaccgtaacgaacgtaaccgaacgtacgtcggtacgtcgtacgaccgtaccg

SEQ ID NO: 390044 - DNA, 548 bp, Homo sapiens
  misc_feature: GZ8MTXP02G7005.13.59.F04.1.454.CMB.2.raw
  modified_base (280)..(280): a, c, t, g, unknown or other
  modified_base (401)..(401): a, c, t, g, unknown or other
  modified_base (448)..(448): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagacgtcaccgtcacgttggccgggcgagtcaacgacattaacacttattagcctggtatcagcagaagccaggganagtcctaaattattgatctctgctgcgtccgccttgacaccgtcggggtcccatcgtcggttcaggtgggcggtggatcgtagacagtattcactctcaccatccacacctcgacaccctnaagtatgttaggtatttatactgtacagtacctagtagtcgcgtccntcgtacgtttcgggacggtacgggacgtaaacgggttcgacgacgaacgttaaccgaaaacggtaaaccgtgggttacggaccgttacggacctaaaccg

SEQ ID NO: 390045 - DNA, 556 bp, Homo sapiens
  misc_feature: GZ8MTXP02GJ24C.13.59.F04.1.454.CMB.2.raw
  modified_base (201)..(201): a, c, t, g, unknown or other
  modified_base (215)..(215): a, c, t, g, unknown or other
  modified_base (228)..(228): a, c, t, g, unknown or other
  modified_base (451)..(451): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttggcccggnagtcacgacattaacacttattagcctggtatcagcagaagccaggagagtaccctaaattatgatctatgctgcgtccgcctgcaacgtccggggtccagtcgtcgtcagtggcgtgatctaggaacagaattcaactctacaccataccaccaacctcgaccacctagatatgtagtaagttattacgtagtacaacgtactagttaaggtcgtcggcccncgttaccgttagttttccgggacgggtaacgggaaccgtaaagggttacgaaccgagtaaactaacgaaaacgtaaccgtaggttacggactacgactaaacccg

SEQ ID NO: 390046 - DNA, 566 bp, Homo sapiens
  misc_feature: GZ8MTXP02I95KK.13.59.F04.1.454.CMB.2.raw
  modified_base (191)..(191): a, c, t, g, unknown or other
  modified_base (205)..(205): a, c, t, g, unknown or other
  modified_base (220)..(220): a, c, t, g, unknown or other
  modified_base (288)..(288): a, c, t, g, unknown or other
  modified_base (300)..(300): a, c, t, g, unknown or other
  modified_base (308)..(308): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatcgacccagtctccatcctccctgtctncattctcttggaanacagacgtcaccgtnacgttcggccgggcagtccacgacaattaacactttattagcctggtatcagacagaagccgaggganagtacctaaatntagatctntgctggcgtccgtccttgactaaccggtccggggtcctagtccgttcggtacgtacgtggggcggtggagttccgtaaggggacagtaaactcactctacacataccctaccaacctcgaccaccagaatacgtgttagtaagttatactgacagtactaagtcggtgtcggtacctgtacgttacgttccgggaggtaacgggaaaccagggttcggaaacagaacgtaacgaaacgacgtagcgactacgactacg

SEQ ID NO: 390047 - DNA, 553 bp, Homo sapiens
  misc_feature: GZ8MTXP02IITIS.13.59.F04.1.454.CMB.2.raw
  modified_base (232)..(232): a, c, t, g, unknown or other
tcagtcacgtactacacgaccggtgctcgatttagtacacacacttagggattgggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctnacagtgacctgcaccgtctctgggctttcactcaaatagaagtacagtgtgtatgagttggattcgtcagtccccagggaagccctggagtgcttgcacgcattgattgggatgatgatacaaaatatacaacacatctatgaagaccaggctacaccatcaccaagactatcttacacgagccaagtgtaccttaagaatagacctaacttcggaccctgtcggaacacgagacacctattacttgtcgacacatacaaaagtctaacttttacaacgttaacggtgtacggacgtcgtcgggggtaccaagggggtccc

SEQ ID NO: 390048 - DNA, 548 bp, Homo sapiens
  misc_feature: GZ8MTXP02FMHJS.13.59.F04.1.454.CMB.2.raw
  modified_base (205)..(205): a, c, t, g, unknown or other
  modified_base (220)..(220): a, c, t, g, unknown or other
  modified_base (285)..(285): a, c, t, g, unknown or other
  modified_base (299)..(299): a, c, t, g, unknown or other
  modified_base (306)..(306): a, c, t, g, unknown or other
  modified_base (316)..(316): a, c, t, g, unknown or other
  modified_base (410)..(410): a, c, t, g, unknown or other
  modified_base (443)..(443): a, c, t, g, unknown or other
  modified_base (447)..(447): a, c, t, g, unknown or other
  modified_base (529)..(529): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcattctcgttgganacagacgtcaccgtnacgttggcccgggcgagtccaacgactattaacattattacgctggtatcagcagacgcgagganacgtacctaaattntgatctngctgccgtcncgtgcaacggtccgggtccatcgttcggtacagggtggcggtggtactacgtaggaactaagtacttacactcctacacctatcccaacctacncgaccacgagacgtagtagttagtacttatacngtanaccgtatataggtcgacgcgtctagtcgttcgggacggtacggacgtaagtcgaaccagtaacgtaacgaaaacggttacgnggtaccgacttcactaccg

SEQ ID NO: 390049 - DNA, 701 bp, Homo sapiens
  misc_feature: GZ8MTXP02HOVQS.13.59.F04.1.454.CMB.2.raw
  modified_base (204)..(204): a, c, t, g, unknown or other
  modified_base (292)..(292): a, c, t, g, unknown or other
  modified_base (372)..(372): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgttgganacagagtccaccgtcacgttcggccgggcgagtcgagggctattagaatgtagttaggctaggtatcagacaagaaaccgaaggaacnccctaagctctagactctagtggtagctactacgtaaggtttaaaacggtcggtaccccagtacgtacggtcaggccggngtaggtgtatcgtaggacctacgtacgtacttctacttcctacaaccgtagttaccgagtcccgtagcccgtacggacctacgtacccgttaagggttaaaccgtttagtttttacgaactttaaaccgttttacgttaacttacggttaaccgtaaaccgtaaagttaactaccgttaaaacttaacgttttaccgttacccgggtttacggggttaaccggtttaaccgggtaaaccggaaaaccgggggtaaccgttaaagggtaacggtaaaaccttaaacggaaaacccggttaacggtcggtaccggtacgtacggtaacccg

SEQ ID NO: 390050 - DNA, 668 bp, Homo sapiens
  misc_feature: GZ8MTXP02IA83A.13.59.F04.1.454.CMB.2.raw
  modified_base (227)..(227): a, c, t, g, unknown or other
  modified_base (332)..(332): a, c, t, g, unknown or other
tcagtcacgtactacacgaccggtgctcgatttagtacacacacttagggattggggggaagaggaagactgacggtcctgccacaggtggtgctgggcacggtggaatcctgctcccccaccatggacatacttttgttccacgctcctgctactgactgtcccgtcctgggtcttgtcccaggtcaccttgagggagtctggtcctgcgctaggtaaaacccaanacggccctcacagtgacctgccaccgttctcgtggtcctttcactcaatagaagtacagttgtgtatgagttggattcgcacgtccccgagggacgcccgtgggngtggcttgcacgctagtgagtgggatgatgataactaaaaatactaacaactaactattccgtaaattacggaaaaccgaccgtacggtacctacctaaccctaactaccctaccgaaacgggtacctaacttaccttaacgaaccgtaacgaccgtaaggttcgtaaccgttaagtaactaaccgaaccgttaacgttaccggtacctacgggtacgaacgtacgacggtacctaaccttattaagttcgtcacactaattacgaaaagtagttactttacgtacgtaacggttcggtacggtacgtacggtaccggggacggtacgggtcccgg

SEQ ID NO: 390051 - DNA, 762 bp, Homo sapiens
  misc_feature: GZ8MTXP02I5UAS.13.59.F04.1.454.CMB.2.raw
  modified_base (276)..(276): a, c, t, g, unknown or other
  modified_base (533)..(533): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctcactctccttgtaggacagagtctaccgtccactgtccggccggagtcgcgacgactaactaacctatttagacctcgtagtacanacgacgaaaggacaccggtaagggacgtacccttaaacctttaaattagttactacttcctcgtacgtcgtccggtacccccggtccccttggtaccgtaaaccgtaccccggggggttcccccgggaccttcgtacccggtttaccgggtcgttaaggggtccgggggttcggtagggtaacctttaccgggggaaaacaacgtaagttacccttacctaccctaccaaccctacctaacccgaaacccaaacccnccctacccgtacccgtaccgtaacgtaacgttaaggttaggttaaaggttaacgttaacgttacgtacgtaaccgtaacgtaacgttaacggtacggtcggtaccggtaccgtaccgttacgttacgggttacgggtaacgggtaaccgggtaaaccggtaacggacgaacgtaacgtaaacgtaaacgtaaacgtaacggtacgtacggtacgtaccgtaccgtaccg

SEQ ID NO: 390052 - DNA, 605 bp, Homo sapiens
  misc_feature: GZ8MTXP02F829T.13.59.F04.1.454.CMB.2.raw
  modified_base (233)..(233): a, c, t, g, unknown or other
  modified_base (282)..(282): a, c, t, g, unknown or other
  modified_base (295)..(295): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcattctcttggagacagacgtccaccgttcacgttggccgggngagtcacgacattaactacttattagcctggtatcagcagacgcaggancgtacctaaattntgatctactgctgtccgtccgtactgcgaacgttcccggggtcctagtccgtcggttacagggtcggcggtgagtcgtagacagtaacttcactctacaccgactaccaaccacgtcacccaccgagtaagtagttaggttaaggtaactttattacgtacgtactaacccggttacttaaggtcggttcgggtccgtccgtcgttacgttaacggggttttcggacggggttacgggaaaccgttacggtagaccgttaagacctaaacgtaaaccggtaaggttcggaacgtcggcgtaccttaaccg

SEQ ID NO: 390053 - DNA, 590 bp, Homo sapiens
  misc_feature: GZ8MTXP02G0AXT.13.59.F04.1.454.CMB.2.raw
  modified_base (201)..(201): a, c, t, g, unknown or other
  modified_base (235)..(235): a, c, t, g, unknown or other
  modified_base (272)..(272): a, c, t, g, unknown or other
  modified_base (284)..(284): a, c, t, g, unknown or other
  modified_base (292)..(292): a, c, t, g, unknown or other
  modified_base (305)..(305): a, c, t, g, unknown or other
  modified_base (340)..(340): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccggcgatcacganattaacattattagcctggtatcagcagagccagganagtacctaattntagatctntgctgccgtaccnccgtgcaacgtccggggtcctagtccgtcggttcnggtcggcgggtggtactcgtagacaagtactactactcctacactactaccgaccactcgaccaaccgtagaactagttcggttaagtagttacttacgtcgttacacggtactaaggttacggtcggtccggccgtcgttacccgttaggtttaccgggacgggaacggttacgggaacgttcgtaccggaataaacgttaaaccgaaaaccggtacgttagggtcggtacctacggacttaaaccccg

SEQ ID NO: 390054 - DNA, 667 bp, Homo sapiens
  misc_feature: GZ8MTXP02GWLS1.13.59.F04.1.454.CMB.2.raw
  modified_base (207)..(207): a, c, t, g, unknown or other
  modified_base (225)..(225): a, c, t, g, unknown or other
  modified_base (243)..(243): a, c, t, g, unknown or other
  modified_base (652)..(652): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagactaccagatgtgacatccaagatcgacccagtcctccactccctcctgtctgcatctcgtagganacgagacgtaccaccgtntaccgttcggcccggganacgtcaacgtactaacttaaactactttagttacgccgttaggtactcacgacaagaacgaccggaaggggactaacggttacccttaaagttcttagtacttcgtcgttcgtcgtcggttcccgtacccgtccgttggtaccgtaccggggtcccggggtaccttacgtccggttcggtacgttgggtcggggtggtggtacttacgtacgggaataacgttataccctacttaccgtaccacctagtacccaaaccctacctcggaccctaaaccgtagtacttacggttaggtaagttaacgtttattacgtaggtacacgttaccgtagttcgtacggtccgtaccgtcgttcgttacgttcgggaacggtcggacgtaggccagacaacgtaagacgtacggtnacgtcacgttacacg

SEQ ID NO: 390055 - DNA, 523 bp, Homo sapiens
  misc_feature: GZ8MTXP02GAP6N.13.59.F04.1.454.CMB.2.raw
  modified_base (202)..(202): a, c, t, g, unknown or other
  modified_base (280)..(280): a, c, t, g, unknown or other
  modified_base (400)..(400): a, c, t, g, unknown or other
  modified_base (487)..(487): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtccaccgtcacgttcggccgggcagtcacgacattaacacttattagcctggtatcagcagaagccaggganagtaccctaaattattagatctctgctagccgtccgccttgcgaacgtccgggggtccatcgtcggttcagtggcggtggatcgtagacagattcactctcacatacaccactgacaccngaacgatgtaggtattattatgtcaacgacctagtagtggtcggccgtcttctagtttcggcggtacgggaacgaggtcgacagganaacgaaaacgtaacgtcgtacggtctacgctaaccg

SEQ ID NO: 390056 - DNA, 726 bp, Homo sapiens
  misc_feature: GZ8MTXP02I5AZ2.13.59.F04.1.454.CMB.2.raw
  modified_base (201)..(201): a, c, t, g, unknown or other
  modified_base (227)..(227): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggnacgtcacgacaattaactactttattagcctggtatcagcagacgccgagggagacgtaccctaaattattagtatcctctgtcgtgtccgtcccgtccttgtacgaccgttcccgggggccctagttccgttcggtttcgacggtgggggtccgggtggtacgttaccgttaaggggaacctaaaggtaactttacccacttccgttaccaacctaacttcccgaaaccccacccgttacggacccctacccgttaagaaccggttaacgttagggtttaacggttaaaggttttaactttaaacgttcgggttaaccccttaaagtacccgtttaaaggttacgggttaccggggttccgggtaaccccgtcgtttacccggtttaagggtttttcccgggggaccgggaacgggggtaacccgtaacgggttagaaccgaagggtaaacttaaccgaaaacgtaaccggttggtacggcttacggctttaaacccg

SEQ ID NO: 390057 - DNA, 581 bp, Homo sapiens
  misc_feature: GZ8MTXP02ISQU9.13.59.F04.1.454.CMB.2.raw
  modified_base (256)..(256): a, c, t, g, unknown or other
  modified_base (534)..(534): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttcggccgggcgacgtccacgacattaactacttattancctggtatcagacagaagccgagggagagtacctaaattattagatctctgctgcgtccgcctgcgaacgtcggggtcccagtcgtcgttcgagtggggtcggtggagtacgtaggaacaggtaattccactcctacaaccactaccaaacccaacccttacgacccaaccctagaaacgtacgttaggttaggtaaagtttacttagtacggtactacgacttaagtggtacggtcgcccgtctcgttacgttcgggacggacgggtacgtaacggngtaccagagtaacgaaaacgtaacgttcggaacgtcgtacgactaac

SEQ ID NO: 390058 - DNA, 524 bp, Homo sapiens
  misc_feature: GZ8MTXP02HY7JC.13.59.F04.1.454.CMB.2.raw
  modified_base (199)..(199): a, c, t, g, unknown or other
  modified_base (213)..(213): a, c, t, g, unknown or other
  modified_base (226)..(226): a, c, t, g, unknown or other
  modified_base (266)..(266): a, c, t, g, unknown or other
  modified_base (454)..(454): a, c, t, g, unknown or other
  modified_base (463)..(463): a, c, t, g, unknown or other
  modified_base (496)..(496): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatgacccagtctccatcctcctgtctgcatctcttgganacagagtccacgtnacttggccggganagtcaacgtacaattaacacttattacgctaggtatcgancgaagaacgccgagggagacgttaccctaaaattattagatctctgcttgccgtccgtcttgacaacggtccggggtaccagttccgtggtttcgagtggggtcgtaggcttacgaggacagtacttcactcacacatacaccgaactgctacagagtatcgttagattatactgacagactagtagngtcggcctntcgtagtcggaggtaacgacgagacgacaaganaacgaacgaacgtacgcgtcgtacacac

SEQ ID NO: 390059 - DNA, 572 bp, Homo sapiens
  misc_feature: GZ8MTXP02HJQ5F.13.59.F04.1.454.CMB.2.raw
  modified_base (363)..(363): a, c, t, g, unknown or other
  modified_base (370)..(370): a, c, t, g, unknown or other
  modified_base (372)..(372): a, c, t, g, unknown or other
  modified_base (382)..(382): a, c, t, g, unknown or other
tcagtcacgtactacacgaccggtgctcgatttagtacacacacttagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctaggtaaaacccaaacaggccctcacagtgacctgcaccgtctcgtggtctttcactcaatagaagtacagtgtgtatgagttgattcgcacgtccccagggacgcctggagtggcttgcacgcattggattgggatgatgaactacaaaatntaacaananatctatgaanaccagtctacaccatcaccgaaagactatctacgacgtacacgaagtcgtacttaagaatacgacctaacgtcgacctgtacgacacgagctacttagtatcgtacactataactaacaaagtacgtaactttactaacgttaacggtacggtacggtacgtcgggttacggaccggtaacggggtcccg

SEQ ID NO: 390060 - DNA, 502 bp, Homo sapiens
  misc_feature: GZ8MTXP02GDY7K.13.59.F04.1.454.CMB.2.raw
  modified_base (201)..(201): a, c, t, g, unknown or other
  modified_base (274)..(274): a, c, t, g, unknown or other
  modified_base (289)..(289): a, c, t, g, unknown or other
  modified_base (390)..(390): a, c, t, g, unknown or other
  modified_base (445)..(445): a, c, t, g, unknown or other
  modified_base (491)..(491): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggcagtcagacattaacacttattagcctggtatcagcagaagccaggangtcctaaatatgatntctgctgcgtccgcttgctaacgtccggggccagtcgtcggttccagggttgggcgtgatcgtaggacagtaattcactctacacataccgaccaaccgtnaccacctagagtatagtgaagtttatcagtaccagtactagtagtgacggccctntgtacgtcggaggacgtacgagtcacagagaacgaacgtacgtcgngcacgactacg

SEQ ID NO: 390061 - DNA, 553 bp, Homo sapiens
  misc_feature: GZ8MTXP02GR2WD.13.59.F04.1.454.CMB.2.raw
  modified_base (201)..(201): a, c, t, g, unknown or other
  modified_base (225)..(225): a, c, t, g, unknown or other
  modified_base (274)..(274): a, c, t, g, unknown or other
  modified_base (397)..(397): a, c, t, g, unknown or other
  modified_base (424)..(424): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcacgtcacttgccgggnagtcacgacattaacacttattagcctggtatcagcagaagccaggganagtccctaaaattattgatcgtactgctgcgtccgcttgcaacgtcggggtccatctcggttcagtggcggtggatcgtagacagattcactctcacatctaccaacctcgacaccctagaanagttgtgtaaagttacttagtacgttnaagtaccctagtaaggtcggtcggtaccccgtcttaccgtgtttttccgggacgggttacggaaccggtaaggcgacgaagtaactaacgtaaaacgaaacgtcggtacggtactacggactaaacccg

SEQ ID NO: 390062 - DNA, 617 bp, Homo sapiens
  misc_feature: GZ8MTXP02GOKO0.13.59.F04.1.454.CMB.2.raw
  modified_base (205)..(205): a, c, t, g, unknown or other
  modified_base (230)..(230): a, c, t, g, unknown or other
  modified_base (312)..(312): a, c, t, g, unknown or other
tcagtcacgtactacacgaccggtgctcgatttagtacacacacttagggattgggggcagaagtctctctcagtcaggacacagcatggacatggagggtccctgctcagctcctgggactcctgctgctctggctcccagataccagatgtgacatccagatgacccagtctccatcctccctgtctgacattctcgttgganacagagtcaccgtcactcggccggngagtccaacgactaataactacttattaacgccttaggtatcagcaagaacgccgagggagtaacgtacctaaaataatttntactctcgtcgtctcgtccgtccgtactcgtacgtaccggtccgggtacctacgtcgttacggtcgtaggtcggggtacgtagtagtacgaacgaagtactaactcactccaacacactacccaaccacgacaccaacagaagtagtagttaagtaattatactacgtaactaacgtacgtagtacgcgtaccggtacctcgttacggtacggttaccgggacgggtaacggtaacggaacgtacgaacgaacgtaaacgtaaacgtaaacgtaacggtacggtacggtacgtacgtacgtaacg

SEQ ID NO: 390063 - DNA, 505 bp, Homo sapiens
  misc_feature: GZ8MTXP02IINI6.13.59.F04.1.454.CMB.2.raw
  modified_base (201)..(201): a, c, t, g, unknown or other
  modified_base (215)..(215): a, c, t, g, unknown or other
  modified_base (271)..(271): a, c, t, g, unknown or other
  modified_base (374)..(374): a, c, t, g, unknown or other
  modified_base (457)..(457): a, c, t, g, unknown or other
  modified_base (492)..(492): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccggcagtcacgacattaacattattgcctggtatcagcagagccaggganagtccctaaattatgatcgtactgctgccgtccgccgttgcaacgtccggggtcccatctcggttcagtggggcgttggatctaagggcagtaattcgatctnaccatccaaccaacctgacacctagacattgttagagtttaactatagtacacgacctatagtggtcgccgctctagtttcgnggaggaccaagtcgactagataaccaaagaacgtnagctacgacaacc

SEQ ID NO: 390064 - DNA, 517 bp, Homo sapiens
  misc_feature: GZ8MTXP02GK20F.13.59.F04.1.454.CMB.2.raw
  modified_base (202)..(202): a, c, t, g, unknown or other
  modified_base (228)..(228): a, c, t, g, unknown or other
  modified_base (280)..(280): a, c, t, g, unknown or other
  modified_base (301)..(301): a, c, t, g, unknown or other
  modified_base (440)..(440): a, c, t, g, unknown or other
  modified_base (481)..(481): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacttggccgggnagtcaacgacattaaacacttatttagcctggtatcagcagaagccaggganagtccctaaatattgaatctntgctgcgtccgcttgcaacgtcggggtcccatctcggttcagtggcggtggatcgtagacagaatcactctcacatcaccaacctgcaccctgaagatgttaggaagtttatatgtacagactatagtggtcgaccgtntctacgttttcggaggtacgggaccgaaaggtcgacagaanaacgaaaacgtaacgtgtaggcttacggactaaacc

SEQ ID NO: 390065 - DNA, 692 bp, Homo sapiens
  misc_feature: GZ8MTXP02HODHW.13.59.F04.1.454.CMB.2.raw
  modified_base (387)..(387): a, c, t, g, unknown or other
  modified_base (441)..(441): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcttggacacgagacgtccaccggttcacgttcggcccgggacgagtccaaccgactattaaaccactttattagcctgggtactcagcaaggaacgccgagggacgacgtaccctaaattattagtactctctgtcgtgtccgtccgtctcgacgtaaccggtccggggtacctacgttcgttcggttacngggtcggacgggtggtactacgtaggaactagtaactctacctactacactacncctaaccctaaaccgtcaccctaccgtagtaagtaacgtttaggttaaggttaaaacgtttttgtaaaccctgggttacctaacgggttaaacccttaggtaaggtttccggggacccggtccgttaaaccgtttccggttaacggttttaaccgggggcggtaaaccgggggtaaacgttaacgggtacgaccggtaaacgtaaccgtaaacgtaaacgtacgtacggtcgtaccggtactaccgtaacg

SEQ ID NO: 390066 - DNA, 649 bp, Homo sapiens
  misc_feature: GZ8MTXP02F7RQC.13.59.F04.1.454.CMB.2.raw
  modified_base (200)..(200): a, c, t, g, unknown or other
  modified_base (298)..(298): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgganacagagtcaccgtcacttggccgggcagtcacgacattaacacttattagcctggtatcagcagaagccagggagagtccctaaattattgatctctnctgcgtccgccttgcaacgtccggggtcccagtctcggttcagtcggggtcggtgggtatcgttaaggactagaaattccactctcaaccattccaacccaacccttcgaccctaaccctagaagtaagttagtttaggtaaaggttttattaacttacgggttactaacgtaacccgtttaagtaacggttacggggtccgggtaccccggtaccttccgttaacggtttttaccgggggaccggggttaacgggggtaaacccggaagggttacggggtaccctaaggaacgtaaccgttaaaacccgaaaacggttggtacccgggggttacgtaccgaccgtaaccg

SEQ ID NO: 390067 - DNA, 584 bp, Homo sapiens
  misc_feature: GZ8MTXP02ICNNF.13.59.F04.1.454.CMB.2.raw
  modified_base (189)..(189): a, c, t, g, unknown or other
  modified_base (202)..(202): a, c, t, g, unknown or other
  modified_base (228)..(228): a, c, t, g, unknown or other
  modified_base (294)..(294): a, c, t, g, unknown or other
  modified_base (302)..(302): a, c, t, g, unknown or other
  modified_base (313)..(313): a, c, t, g, unknown or other
  modified_base (367)..(367): a, c, t, g, unknown or other
  modified_base (379)..(379): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtcngcatctcttgganacagactcaccgtcacttggccgggngacgtcaacgacaattaactattattacgcctggtatcagcagagccgaggagacgtacctaaatntagatctntgctgcgtccncctgcgacgtccggggtcctagtcgtcggttcgaggtcggcggtgactcgaganagtactcctacnctacactactcaccacctcgacctacctagaacgtagttagttagtaagtttacttaacgtggtaacctacgtaaaccttagtacgggttacggtccgggtccgtacgtttaccgttacgggtttacgggacggggtaacggtaccggtaaaggtcgaacgtacgaaacttaacggaaacgtacgtaggtacgcgtacactaccg

SEQ ID NO: 390068 - DNA, 671 bp, Homo sapiens
  misc_feature: GZ8MTXP02GZU09.13.59.F04.1.454.CMB.2.raw
  modified_base (280)..(280): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcattctcttggagacagacgtcaccgttcacttggccggtcagtcacgacattaacacttattagcctggtatcagcagaagccgaggganagtccctaaagttacttgatctctgctgccgtccgtcttagctaaccgtcgggggtacccctagtccgttcgggttaccaggtcggggtcgggtcggtaacgtccgttaaggacgaataacttacgtaacttcctacaccatacccaacccgtaaacctcgaccctacccgtagaaacgtagttaggttacgggtaattttagtttaacgttcgggtacctaaccgtaccgttaaagtttacgggttcggggtccgggtaacccggtccgtaaccgtttacggttttccggggaccggggaaacggggttacccggaaaagggttcgtacgtaaccgaagttaacccgaaacggtaaacccgttggtaacggtacttacggcctaaacccg

SEQ ID NO: 390069 - DNA, 728 bp, Homo sapiens
  misc_feature: GZ8MTXP02H7825.13.59.F04.1.454.CMB.2.raw
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtcctcactcctcctgtctgcacttctcgttggagacagacgtccaccgtcacgttggccgggcgagtccaacgactaacttaactacttattacgtccgtaggtatcagcaagaacgaccgagggaacgtaacgttacccttaaatttacttagacttctcgtagtctcgcgttccgtccgttcgacgtaacccggtccggggtaccctacgtccgttcggttcgacgggttcgggcgggttagacgttagtaacggacgtaaattaactacctacctacctacctaaccgtacacccaacctaaccgtcacccacccgttagaacgtaagttaggttacgggtaaattttacgttacgtacgttaaccgtaacgtaaacccttaggttaacggtcggggttacccggtacccgtttccgttacggtttaccgggttttaccgggggaccgggggtaaaccgggtaacccgggttaaagggtacgaaccgttaaggaaaccgtaaaaccggtaaacgtaaaccggttggtaaccgggcctacggttaccctaaacccg

SEQ ID NO: 390070 - DNA, 580 bp, Homo sapiens
  misc_feature: GZ8MTXP02GZ7SY.13.59.F04.1.454.CMB.2.raw
  modified_base (198)..(198): a, c, t, g, unknown or other
  modified_base (203)..(203): a, c, t, g, unknown or other
  modified_base (231)..(231): a, c, t, g, unknown or other
  modified_base (268)..(268): a, c, t, g, unknown or other
  modified_base (307)..(307): a, c, t, g, unknown or other
  modified_base (566)..(566): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatcctntgganacagacgtcaccgtcacgttggccgggnagtcacgactattaacacttattacgcctggtatcanacgagagccgaggagacgtacctaaatatgatctctgtntgtcccgtccgtccttagcgaccggtccggggtaccctagtccgttcggtttccgagggttcggggtacgggtggtacgtacgtaggaacagtaacttctactcctacacccatacccgacctacctcgcccaacccgtagaacgtagtggttaggtaatttcgtatgtacagtactgttaggcggtcgtcctactgtacggttcgggaggtacccgggaatacggtcgacgtagaaccgaagttaaaccgagttcggnggcctacgctaacc

SEQ ID NO: 390071 - DNA, 543 bp, Homo sapiens
  misc_feature: GZ8MTXP02IZMOM.13.59.F04.1.454.CMB.2.raw
  modified_base (201)..(201): a, c, t, g, unknown or other
  modified_base (215)..(215): a, c, t, g, unknown or other
  modified_base (228)..(228): a, c, t, g, unknown or other
  modified_base (410)..(410): a, c, t, g, unknown or other
  modified_base (424)..(424): a, c, t, g, unknown or other
  modified_base (448)..(448): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttggccgggnagtcacgacaattaacacttattagcctggtatcagcagaagccgaggagagtacctaaattattgatctctgctgccgtccgtccttgacgtaacgtccgggggtccctacgtcgtcggttccgaggtcgggtcgggtggactccgtaaggacgagtaaatcactctcacatccaacaccncgacaccagaagtntagttaggaactttatactagtanagtacgtatacggtgttcgccgtctctacgtttcggacggtacggacgaacgtcgagagagtaacgaaacggtatacggtcgacttacgacaacg

SEQ ID NO: 390072 - DNA, 530 bp, Homo sapiens
  misc_feature: GZ8MTXP02FFV6M.13.59.F04.1.454.CMB.2.raw
  modified_base (204)..(204): a, c, t, g, unknown or other
  modified_base (225)..(225): a, c, t, g, unknown or other
  modified_base (248)..(248): a, c, t, g, unknown or other
  modified_base (293)..(293): a, c, t, g, unknown or other
  modified_base (342)..(342): a, c, t, g, unknown or other
  modified_base (363)..(363): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacngagtcaccgtcactgccgggnagtcacgacataacacttattancctggtatcagcagagccagggagagtacctaaattatgatctcngctgcgtccgccttgacacgtccggggtccatctcgttcaggtggcggngatgtagacagtatcacttcncacatcaccaactcgccacctagaatagtgtagggtaatttattaactggtacacgtacctagttagttggcggccctactcctagtttcgggacggtacggaccgtaagggcacgtaggtaactaaccgaaaaacgtaaccgtaggttacggccgtacgacgaccg

SEQ ID NO: 390073 - DNA, 585 bp, Homo sapiens
  misc_feature: GZ8MTXP02F3WUK.13.59.F04.1.454.CMB.2.raw
  modified_base (190)..(190): a, c, t, g, unknown or other
  modified_base (203)..(203): a, c, t, g, unknown or other
  modified_base (231)..(231): a, c, t, g, unknown or other
  modified_base (282)..(282): a, c, t, g, unknown or other
  modified_base (303)..(303): a, c, t, g, unknown or other
  modified_base (306)..(306): a, c, t, g, unknown or other
  modified_base (399)..(399): a, c, t, g, unknown or other
  modified_base (547)..(547): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctccctgtctncatctcgttgganacagagtccaccgtcacgttggccgggnagtcaacgacattaacacttattagcctggtatcagcagaagccgaggganacgtacctaaattatgatctntanctgctccgacttcgacgtaaccggtccggggtccagtccgttcggtacagggtgggcgggtggtaacgtcgtaggacagtaattccacttccncacctatccgaaccacgtcaccttaccgagaagtagttggttaggtaatttagttactacgtcaaacgtacctagtaggtcggtcgcccgtcgttaaccgttggtttaccgggagggtacgggtaaccgagggtacgcgtaaaggtanaaaccgtaaaacgtgttaggtcggccgtaacgactacg

SEQ ID NO: 390074 - DNA, 617 bp, Homo sapiens
  misc_feature: GZ8MTXP02H14PP.13.59.F04.1.454.CMB.2.raw
  modified_base (206)..(206): a, c, t, g, unknown or other
  modified_base (221)..(221): a, c, t, g, unknown or other
  modified_base (289)..(289): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgctatctcgttgganacagacgtcaccgtnacgttcggccgggcgagtcacgaacattaaactacttattacgcctagtatcagcagacgccaggganaacgttccctaaattattgatctctgtctgcccgtccgtcctgactacggtccggggtccctagtccgttcgtcgagtcggggtcgtggactccgtaagacagtaactccgtactcctacacctactcccaaacccgtacctacgacccacccgtagaacgtaacgttggttaaaggtaacgtttatacgttacggtacaacggtaccttaggtacgtgggtccggtccgtacttcgttaacggtttcggacggggacgggtaaaccgtaagggcgacgtaacgacgtaaaccgaacggtaacgtcggtacgtaccgtcgaccctacg

SEQ ID NO: 390075 - DNA, 721 bp, Homo sapiens
  misc_feature: GZ8MTXP02FMK8L.13.59.F04.1.454.CMB.2.raw
  modified_base (190)..(190): a, c, t, g, unknown or other
  modified_base (512)..(512): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgaccagtctccatccctccctgtctnctatctcgttggagtacagacgtccaccgtcacgttcggccgggcgacgtaccaacgaactaacttaacctatttaattacgccttagggtactacacgacgaagaacggaccgaaggggataccggttaacctaaaatttattcggattcctcgttagccgtcggtaccgttcccgtccgttaggaccgtaaaccgggttcccgggggtacccctgttccggtttacggtcggtaagggtcgggggtccggtaggtaacgttccgttaagggaactaacgttacttacacctttcacccaaccgtactaccctaaaccccnccgtaccgaccgtaacgtagtaacgttacggttaggttaacgttaacgttagttacgtaacgtacgtaaccgttaggttacggtacgggtccggtaccggtaccgttacgttacggttacggggtacggggaacgggtaacggacgtacggaccgtaaacgaacgtaacgaaaccgtaacggtacggtacggtcgtacgtacgtactcg

SEQ ID NO: 390076 - DNA, 582 bp, Homo sapiens
  misc_feature: GZ8MTXP02G893W.13.59.F04.1.454.CMB.2.raw
  modified_base (212)..(212): a, c, t, g, unknown or other
  modified_base (222)..(222): a, c, t, g, unknown or other
  modified_base (270)..(270): a, c, t, g, unknown or other
  modified_base (287)..(287): a, c, t, g, unknown or other
  modified_base (295)..(295): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttgagacagagtcacgtnacttgccggnagtcacgacattaacacttattagcctggtatcagcagaagccagganagtaccctaaattattnatctcgtntctcgtcgtccgtctgacgtaccggtccggtcctatcgtacgtcgaggtcggtacgtgtactacgtagaactagtactcactcctaccacactacccaacctaccgtcgaccaccgtacgtaagtagttagttacggttaacgttattacgtacgtacgtacgtacgttagtacgtcggtacgtccgtacgttacgttacggttacgggtacgggtacggtaacggtaacggtacgtacgaacgaacgtaacgtaaacgtaacgtacggtacgtcgtacgtacgacg

SEQ ID NO: 390077 - DNA, 581 bp, Homo sapiens
  misc_feature: GZ8MTXP02GFRI7.13.59.F04.1.454.CMB.2.raw
  modified_base (205)..(205): a, c, t, g, unknown or other
  modified_base (291)..(291): a, c, t, g, unknown or other
  modified_base (305)..(305): a, c, t, g, unknown or other
  modified_base (314)..(315): a, c, t, g, unknown or other
  modified_base (417)..(417): a, c, t, g, unknown or other
tcagtcacgtactacacgaccggtgctcgatttagtacacacacttagggattgggggcagaagtctctctcagtcaggacacagcatggacatgagggtccctgctcagctcctgggacctcctgctgctctggctcccagataccagatgtgacatccagatgacccagtctccatccctcccgtgtctgacatctcttgganacagacgtcaccgtcacgttcggccgggagagtccaacgaacaacttaactacttatttatcctggtatcagcagaagccgagganacgtacctaaattntgatctctnntgcgtccacctgctaacggtccggggtcccattccgtcggttcagtgggcggtggtaactcgtaaggacataacttcacttcacaaccataccaccaactcnccaccctagaagtagtagttaggtaaggttagttataggtactacgacctagttaagtcggtcgtccggtcttacgtaccgttgggttacggtacgggtaccggtaaacgggtacgacgaagtaacgtaacgaacgtaacgtacgtacgtacgtacgtactacg

SEQ ID NO: 390078 - DNA, 712 bp, Homo sapiens
  misc_feature: GZ8MTXP02I882F.13.59.F04.1.454.CMB.2.raw
  modified_base (195)..(195): a, c, t, g, unknown or other
  modified_base (340)..(340): a, c, t, g, unknown or other
  modified_base (434)..(434): a, c, t, g, unknown or other
  modified_base (487)..(487): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctcctgtcctgacncttctcgttagggacacagtacgtccaccgttcacgttcgggcccgggtacgacgtaccgaacgtaactaacgtttaaacctacgttttaaagttacgccgtttaggtactaccgagacccgaaggaacgccggtaaggggaacncggttaaccctaaatttatatacttctcgtgtccgtcgtcccgtccgtcgttacggacctaacggtcccggggaccctgtccgttcggtaccgnggtcggggtaccgtggtacttacgaggataactacttcacttcaccaactacncccaaacgtcctcacctacgagtaagtagttagttaaggtaaactttgttacctgggttaacccagttaccgttaaggttccggtagggtccccggtccttaaacgttcccggtttaaggggtttcccggggaaagggttaccggggaaaacgttagggccgaaccgttaaggtaccctaagggaaaacccgttcggttaaggtcggtaaaccctcgtacgtacg

SEQ ID NO: 390079 - DNA, 609 bp, Homo sapiens
  misc_feature: GZ8MTXP02IUAP2.13.59.F04.1.454.CMB.2.raw
  modified_base (199)..(199): a, c, t, g, unknown or other
  modified_base (205)..(205): a, c, t, g, unknown or other
  modified_base (314)..(314): a, c, t, g, unknown or other
  modified_base (319)..(319): a, c, t, g, unknown or other
  modified_base (357)..(357): a, c, t, g, unknown or other
  modified_base (409)..(409): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtctccattcctccctgtctgcatcctnttgganacagacgtccaccgtcacgttcggccgggcaggtccacgacaattaactaactttattagacctggtatcagacagaagaccgaagggagcgtaaccctaaattagttnatctnttcgctcgcgtcctctagacgtacggtcccggggtctnttccgttcggtctgggtgggtcgtggtactcgtaaggacagtactctattcnccacatccaaacctcgcaccaccagaagtagttagtttaaggtaccttttattacgtcgtaacgagttaaccgttagtagggtccgtcggaccgttcttccggtttaacggtttcgggacggggttaaacgtaaaccgtaaggggccaacgaggtaacttaaacgaaccgtaaggttccgaggtaccgtacgtacgtacg

SEQ ID NO: 390080 - DNA, 535 bp, Homo sapiens
  misc_feature: GZ8MTXP02HZD4U.13.59.F04.1.454.CMB.2.raw
  modified_base (201)..(201): a, c, t, g, unknown or other
  modified_base (215)..(215): a, c, t, g, unknown or other
  modified_base (270)..(270): a, c, t, g, unknown or other
  modified_base (281)..(281): a, c, t, g, unknown or other
  modified_base (387)..(387): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttggccgggcgagtcacgactattaaactacttattagcctaggtatcaganagagcaggganagtacctaaatatgatctctgctgcgtccgcttgcaacgtcggggtccatctcgtgagtggcgtgatcgtagacagaacttcactctacaacatccaaccaccctnccacctagaacgtatgttaggaaatttattactgtcaacgtactaagtaggtcgtcggcctctacgtacgtttcgggaccggaacggggaacctaaggtcgaacgtagaattaaccgaaaagtaaaccgtgtacggcctagaccctac

SEQ ID NO: 390081 - DNA, 757 bp, Homo sapiens
  misc_feature: GZ8MTXP02F37DL.13.59.F04.1.454.CMB.2.raw
  modified_base (235)..(235): a, c, t, g, unknown or other
  modified_base (273)..(273): a, c, t, g, unknown or other
  modified_base (297)..(297): a, c, t, g, unknown or other
  modified_base (305)..(305): a, c, t, g, unknown or other
  modified_base (746)..(746): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggcctccagataccagatgtgacatccagatcgacccagtcctccatccctccctgtctgctatctcgtggagacagagtccaccgttcacgttcggccgggntagtcgaggacagttaagaatgtagttaggctggtacncagacaacgaaaccgaggaaaccncccgtaancttcgtagactcgtagtcggtactctaaacgttaccgtaaaaggtttaaaacggtccggtaacccctaagttcgtaaaaggttccgaacggtcggaacgtaggggtcgtaacgtcgtacggtacctaacgtacggttaactttacctaacttcccctaaccgaaaccctacgttacccgaacggtcccacgttaccccgtacgacccgtacgtaccggttaaagtaaaacggttttccttttaacggaaacccttttaaaagtttactttaaaacccggttgttaaaccctaaacggtaaaattaccctaaaccgttaaattaaaccggttttacgtacccggggttaaacggggttcccggttaaaacccggaacgggtaaaacccgggtaaaaggacggttaaaacggaaactaacggaaaaacgttcgtacgggtacncgtacgtaacc

SEQ ID NO: 390082 - DNA, 680 bp, Homo sapiens
  misc_feature: GZ8MTXP02HB3JR.13.59.F04.1.454.CMB.2.raw
  modified_base (202)..(202): a, c, t, g, unknown or other
  modified_base (216)..(216): a, c, t, g, unknown or other
  modified_base (263)..(263): a, c, t, g, unknown or other
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacttgccgggcgagtcacgacattaaacacttattagcctggtatanagacaagaacgacgaaggagtaacgtaacctaaattatatatctctgctcgtccgtccgtcttagacgtaaccggtccggggtacctacgtcgttcggttacgtaggtcggggtcggtaggtaacgtacgtaaggtaacgaaagtaactacctaactcctacctaaccaactacccaacccgtaaaccctcgaccctaccgtaagtaaagtaagttaggttaaggttaaacgtttaacttaacgttacgtaacgaacgtaaacgtaagttaacggtacgggtaccggtcccgtaccgttacgttacggtttacgggtacggggtaaacgggtaaaccggtaaacggtacgaacgtaacgaaacgtaaaacgtaaaaacgtaaaacgtacggtacggtaccgtacgtaaccgtaaccg

SEQ ID NO: 390083 - DNA, 522 bp, Homo sapiens
  misc_feature: GZ8MTXP02F7L0A.13.59.F04.1.454.CMB.2.raw
  modified_base (336)..(336): a, c, t, g, unknown or other
  modified_base (384)..(384): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtaccctaaattatgatctctgctgcgtccgcttgcaatcgtgggtccatctcgttcngtggcggtgatcgtaggacagtattcactctcacatcacactgcaccnaagatgtagagttattactgtacagactagtagtggtcgtccgctactacgttttcgggacggttaacggggaccgtaagggtcgacgtaaggaacgttaacgaaaacgtaaaccgttggtacggacgttcggaaccc

SEQ ID NO: 390084 - DNA, 575 bp, Homo sapiens
  misc_feature: GZ8MTXP02GFX1H.13.59.F04.1.454.CMB.2.raw
  modified_base (202)..(202): a, c, t, g, unknown or other
  modified_base (440)..(440): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttgganacagacgtcaaccgtcacgttggccgggatacgtacacgacattaactacttattagcctggtatcaagcaagacgaccgaggacgacgttaccctaaattatgactctacctgctgccgttccgccttaggctaaccggtccggggtccattccgtcgttcgaggtcgggcgggtaggtagtacgtaacgataagaacttcactctacacgactacccaccgactcgacccacgtanaagtagtagttaggtaatttagtactagtactagaccgtataggtcgaccggcctctacgttacggttcggacggaacggtaacgagtcgaacgcgaaaacgtaacgaaacgtacgtagcggtactacgacgtac

SEQ ID NO: 390085 - DNA, 560 bp, Homo sapiens
  misc_feature: GZ8MTXP02JTL6P.13.59.F04.1.454.CMB.2.raw
  modified_base (204)..(204): a, c, t, g, unknown or other
  modified_base (209)..(209): a, c, t, g, unknown or other
  modified_base (279)..(279): a, c, t, g, unknown or other
  modified_base (295)..(295): a, c, t, g, unknown or other
  modified_base (310)..(310): a, c, t, g, unknown or other
  modified_base (407)..(407): a, c, t, g, unknown or other
  modified_base (418)..(418): a, c, t, g, unknown or other
  modified_base (494)..(494): a, c, t, g, unknown or other
  modified_base (552)..(552): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccactcctccctgtcctgctatctcttgganacagngtccaccgtctacttggccgggcaggtcaacgactaattaaactactttattacgccttaggatcgaganagaacgccgaaggganacgtaccctaaattnttacgatctctcgcttgcgtccgacttgcaacgtccggggcctatcgtcgtcgagttcggggcgtggattcgaaggtcaatagtacatctcacctanccaaccctacncaccaccctagtaagtagttagttacggttaagtttaattaccgttgtacatacgtaagtcggtaggccgtacgtntacgtcgtttcgggacggacgggacttaggcgacgatagaacgaaactcgtaggtccncgacacac

SEQ ID NO: 390086 - DNA, 534 bp, Homo sapiens
  misc_feature: GZ8MTXP02GEZ1H.13.59.F04.1.454.CMB.2.raw
  modified_base (206)..(206): a, c, t, g, unknown or other
  modified_base (233)..(233): a, c, t, g, unknown or other
  modified_base (268)..(268): a, c, t, g, unknown or other
  modified_base (286)..(286): a, c, t, g, unknown or other
  modified_base (308)..(308): a, c, t, g, unknown or other
  modified_base (318)..(318): a, c, t, g, unknown or other
  modified_base (408)..(408): a, c, t, g, unknown or other
  modified_base (429)..(429): a, c, t, g, unknown or other
  modified_base (458)..(458): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccgtccctgtcctagcatctcgttgganacagatccaccgtcacgttggcccggnagtccaacgacattaacattattagcctggtactnagcaagaagccgaggganacgtacctaaattatgatctangctgactccncgttgcaacgtccggggtcccatctcggtacaggtcgggcgtagacttagacggaactagaacttcattcacacataccaccaacccgtnccacagagtatgtaagtattntatgtacacgtactgtagtcgtcgtcctnttacgttacgtacggaggacgaacgtacggtcgacgaagtacgaaacgtaacgacgtacggcgactacgacctacg

SEQ ID NO: 390087 - DNA, 725 bp, Homo sapiens
  misc_feature: GZ8MTXP02FI0TK.13.59.F04.1.454.CMB.2.raw
  modified_base (194)..(194): a, c, t, g, unknown or other
  modified_base (198)..(198): a, c, t, g, unknown or other
  modified_base (281)..(281): a, c, t, g, unknown or other
  modified_base (321)..(321): a, c, t, g, unknown or other
  modified_base (384)..(384): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccatctccactccgtcctgtctgactntctntggacgacagtacgtccaccggtcacgttcggcccggcgtagtccacgaactaacttaactacttatttacgccgtggttacncgagcaacgacgtccggagggacgacgttaccctaaattnttgacttctacgtcgtctcggtcccgtccgtaccttcgacgtaaccccgggtccggggtaccngtttccgtcggttacgcgggtcgggtaccggtggtacttacgacgggtaactacgtaaacttccaacttcctaccaaccttacctacccaaccccggaaacgttccacccgtaacccgtaggtaaaccgttagttagggtttaacggttaaacttttaacgttaccgttaacgggtcctaacgttaaccgttaaggttacggttcggaacccgggccttcgttacggtacggttttaccggggacgggttaaacccgggtacgtaaacggggtcaacgtaacggaaaccgtaaacgaaaacccgttaggcggttacgtccggaccgttacctaaacccggg

SEQ ID NO: 390088 - DNA, 665 bp, Homo sapiens
  misc_feature: GZ8MTXP02F2WG4.13.59.F04.1.454.CMB.2.raw
  modified_base (153)..(153): a, c, t, g, unknown or other
  modified_base (205)..(205): a, c, t, g, unknown or other
  modified_base (219)..(219): a, c, t, g, unknown or other
  modified_base (234)..(234): a, c, t, g, unknown or other
  modified_base (269)..(269): a, c, t, g, unknown or other
  modified_base (296)..(296): a, c, t, g, unknown or other
  modified_base (312)..(312): a, c, t, g, unknown or other
  modified_base (319)..(319): a, c, t, g, unknown or other
  modified_base (382)..(382): a, c, t, g, unknown or other
  modified_base (441)..(441): a, c, t, g, unknown or other
  modified_base (454)..(454): a, c, t, g, unknown or other
  modified_base (539)..(539): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtnacatccagatcgacccagtctccatcccgtccctgtctgcagttctctgganacagagtcaccgtnacgttggcccggtanagtcagactaacttaccattatttagccttaggtntaccagacctagaacgccgaggggtanacgtacctaaattatnattcgtntgctcggtcctccgtaacttggaccaacggtcccggggtaacctgtccgttaacggttaccgngggtccgggtaagggtcgtagttaccgagggaactagtaaacttcaacttccacaactnacccaccaccggnacccttaccagagttacctaggtaaggtaaccctttataccggtgttacgaaacccttgtaagtcggttacggggccgtcccctnttaaaaccgtttgggtttcccgggaggtaacccggaaaacggttcgggtaccgtaaacccgaagtttaaaccctaaaggggtaaaaccctaaacgggtacggtacgtacgtacctacgttaaccgg

SEQ ID NO: 390089 - DNA, 547 bp, Homo sapiens
  misc_feature: GZ8MTXP02FJFAE.13.59.F04.1.454.CMB.2.raw
  modified_base (225)..(225): a, c, t, g, unknown or other
  modified_base (288)..(288): a, c, t, g, unknown or other
  modified_base (348)..(348): a, c, t, g, unknown or other
  modified_base (352)..(352): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggacacagagtcacgtcacttggccggnagtcacgactattaacacgttattagctggtatcagcagagccgaggagacgtacctaaattnttgattctatgctgtcgtccgctgctaacgtccggggtccagtcgtcggttcaggtcggngtgntacgtagacagtaaacttcactcacacctatcctaccaactcgactaccgtagacgtagtgtagtaagttatactagtactaacgactagtacgtggtcgtcccgtactcgtacgtttcggacggtacgggtaacctaggtacgacgaagtacgtaacgtaaacgtacgtaggtacggtcaacgacgtaaacccg

SEQ ID NO: 390090 - DNA, 568 bp, Homo sapiens
  misc_feature: GZ8MTXP02FJCZ8.13.59.F04.1.454.CMB.2.raw
  modified_base (228)..(228): a, c, t, g, unknown or other
  modified_base (271)..(271): a, c, t, g, unknown or other
  modified_base (310)..(310): a, c, t, g, unknown or other
  modified_base (312)..(312): a, c, t, g, unknown or other
  modified_base (321)..(321): a, c, t, g, unknown or other
  modified_base (327)..(327): a, c, t, g, unknown or other
  modified_base (365)..(365): a, c, t, g, unknown or other
  modified_base (415)..(415): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgacatctcgtggatacagatcaccgtcacgttggccggnagtccaagactaattaacatttacttacgtcctggtaatcgancgaagaacgcgagggagacgtaccctaattatgatcgtntnctgccgtcncgttcncgaaccgtccggggtccatcgtcggtcaggttcggggngtgtagtacgagtatagtactactactcctaccaacactacccaccgacncgacctacgtagtaagtagttaggttaagtaagttacttagtacgtatacgtactagtaggtcggccggtcctagttctacgggttcggaacgggtacggaacgtaggacgtacgagtaacgtaacgaaacgtacgtcgtcgacgcgtacacg

SEQ ID NO: 390091 - DNA, 616 bp, Homo sapiens
  misc_feature: GZ8MTXP02F81QW.13.59.F04.1.454.CMB.2.raw
  modified_base (228)..(228): a, c, t, g, unknown or other
  modified_base (244)..(244): a, c, t, g, unknown or other
  modified_base (570)..(570): a, c, t, g, unknown or other
  modified_base (578)..(578): a, c, t, g, unknown or other
  modified_base (585)..(585): a, c, t, g, unknown or other
  modified_base (606)..(606): a, c, t, g, unknown or other
  modified_base (614)..(614): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatcccgtcctgtctgactatccttgttggagtacaggattccacccggttnacgttcggccccgggngtacgtccaacgtataaacttaactacttaatttacgccgttaggtatacagaccaaggagaccgagggtacgacgtaacctaaattattgactctcgtgtcctggtcccgtaccgtcgttacgccgtaacccggtccggggaaccctgttccggttacggtttcgacggtggggtccggtggtactacggttaacggataaagtaacttcctaactccgttacacctagtaccaaccctacgaccacctccgtaagagtagttagttaaggttaatttagttactcgtaatacgtactagtcgtgtcgacgtctgtcgttacggnggtacggntaacggngacgagacaagacgtacgtgngcgcgacncg

SEQ ID NO: 390092 - DNA, 607 bp, Homo sapiens
  misc_feature: GZ8MTXP02JKPMS.13.59.F04.1.454.CMB.2.raw
  modified_base (233)..(233): a, c, t, g, unknown or other
  modified_base (286)..(286): a, c, t, g, unknown or other
  modified_base (300)..(300): a, c, t, g, unknown or other
  modified_base (383)..(383): a, c, t, g, unknown or other
  modified_base (421)..(421): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccactcctccctgtctgcattctcgttggagacaagcgtcaccgtcacgttcggccggntagtcacgactaattaacacttattagcctagtatcagacagagaccgagganacgtacctaaattntagatctctgctcgccgtccgactgctaaccggtcgggtcctatcgttacggtctagggtggtcggtgtagtcgtaacggtanacgtaatcactctaaccacactaaccgaccctaacccncgacctacgtagtaagttagttaggttaacgttaatttacgtacgttacgtacgtaacgttaacgttagttacggtcggtccgtccgtcgttacggtttacgggttacgggacgggtaacgggacgtacggacgtacggaactaacggtaaacgaaacgtacgtacggactaccggtacacctacg

SEQ ID NO: 390093 - DNA, 629 bp, Homo sapiens
  misc_feature: GZ8MTXP02JO6LF.13.59.F04.1.454.CMB.2.raw
  modified_base (202)..(202): a, c, t, g, unknown or other
  modified_base (280)..(280): a, c, t, g, unknown or other
  modified_base (292)..(292): a, c, t, g, unknown or other
  modified_base (300)..(300): a, c, t, g, unknown or other
  modified_base (312)..(312): a, c, t, g, unknown or other
  modified_base (318)..(318): a, c, t, g, unknown or other
  modified_base (334)..(334): a, c, t, g, unknown or other
  modified_base (344)..(344): a, c, t, g, unknown or other
  modified_base (358)..(358): a, c, t, g, unknown or other
  modified_base (367)..(367): a, c, t, g, unknown or other
  modified_base (378)..(378): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccatcctcccgtgtctgcatctcgtgganacagagtccaccgtcacgttcggccgggcagtcacgactattaacacttattagcctggtatcagcagagccgagganacgtacctaatntagatctntgctgccgtccncttganaacgtccggggtaccngtcgtcgttnaggtggcggtagtnttacgaganaagtacttacnctactacacctacaccgaaccaccggcaccttaccgagtaagtagttagttaaccgttaaggttacttacttagggttaacgaacctaacgttaaagttacgggtcgggttacccggtacccgggttcttaccgtttacgggtttaccgggtaccgggggtaaacggggtaaacccgtagggtacccgtacgtaaaaggtactaaacccggaaaaacgtacggttacggggtacgtacgtacgtacgtacg

SEQ ID NO: 390094 - DNA, 479 bp, Homo sapiens
  misc_feature: GZ8MTXP02GGKAV.13.59.F04.1.454.CMB.2.raw
  modified_base (152)..(152): a, c, t, g, unknown or other
  modified_base (202)..(202): a, c, t, g, unknown or other
  modified_base (216)..(216): a, c, t, g, unknown or other
  modified_base (287)..(287): a, c, t, g, unknown or other
  modified_base (291)..(291): a, c, t, g, unknown or other
  modified_base (359)..(359): a, c, t, g, unknown or other
  modified_base (372)..(372): a, c, t, g, unknown or other
  modified_base (374)..(374): a, c, t, g, unknown or other
  modified_base (379)..(379): a, c, t, g, unknown or other
  modified_base (381)..(381): a, c, t, g, unknown or other
  modified_base (397)..(397): a, c, t, g, unknown or other
  modified_base (401)..(401): a, c, t, g, unknown or other
  modified_base (448)..(448): a, c, t, g, unknown or other
  modified_base (470)..(470): a, c, t, g, unknown or other
  modified_base (473)..(473): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgngaccatccagatgacccagtctccatcctccctgtctgcatctcttgganacagagtcaccgtnacttgccgggcagtcacgcattaacacttattagctgatcagcagagcagggaagtacctaaatattcatntctnctcgcgtccgcttgcaacgtcgggtccgctctcgttcgagtggtcgtgagtagagacagactactctnacacacacacacncncacananatgtagtattatatanacanactagtagtcgtcgcctctctacgttcggacggacgacgacgacganagaagtaacgaaacaacgtcgngcncgacac

SEQ ID NO: 390095 - DNA, 805 bp, Homo sapiens
  misc_feature: GZ8MTXP02FNLE7.13.59.F04.1.454.CMB.2.raw
  modified_base (233)..(233): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgaccccagtctccatcctccctgtcgtgcatcttcttggagacagagtcaccgtcacgttcgcccgggnagtccaacgacattaacattattacgcctggtatcgagacagaagtccgagggacgtaacgtacccttaaatttattagacttacttcgtagtctcggtccgttacccgacctttcggaccgtaaccggttccccggggggttaccccctacgttccgttaccggttacgtacgggttacgggggccgggttacgggtaacgtttaccgtaaggggtaaaccctaagggtaaaacctttaccctaaacctccctaaccctaaccctaaactacccctaaaaccccaaacccgttacacccccgtaacccgttaaacggtaaacgtttaaggttagggttttaaaggggtaaaacggtttttaacgtttaccgtttaacgggttaaaccgtaccggttaaacccgttaaaggtttaaacggggttcggggttccggtccccgttacgttacgttaacggtttttcccgggggacgggtaacgggggaaaccgtaacggggtacgtaccgaaggtaagtaacccgtaaaaccgggtaaaccttcggggtaggtacgtaccggtaacctaacccg

SEQ ID NO: 390096 - DNA, 586 bp, Homo sapiens
  misc_feature: GZ8MTXP02IT6FF.13.59.F04.1.454.CMB.2.raw
  modified_base (204)..(204): a, c, t, g, unknown or other
  modified_base (235)..(235): a, c, t, g, unknown or other
  modified_base (276)..(276): a, c, t, g, unknown or other
  modified_base (313)..(313): a, c, t, g, unknown or other
  modified_base (315)..(315): a, c, t, g, unknown or other
  modified_base (344)..(344): a, c, t, g, unknown or other
  modified_base (362)..(362): a, c, t, g, unknown or other
  modified_base (457)..(457): a, c, t, g, unknown or other
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgcatctcgttgganacagacgtccaccgtcacgttcggcccgggngagtccaacgaactaattaactattattacgctgtatcagnaagagaccgaggacgacgtacctaaattatgattctntnctgtcgtccgctgcaacgtccgggtaccngtcgtcggtcaggtcggnggtagatcgtaggacagtattcactacctcaccgataccaaccgacctacacctaccgagaagtagtaggttaagtaagtttactactacggtanaaaccgtacgttaagttagggtcggttaccggcccgtacgtcgttaacggtttcgggacggggttaaacgaccgggttaagcgtacgacgaacgtaacgaaacgtaacttgggaccgcgtacacctacg

SEQ ID NO: 390097 - DNA, 526 bp, Homo sapiens
  misc_feature: GZ8MTXP01AMKJ6.8.80.H03.1.454.CMB.2.raw
  modified_base (253)..(253): a, c, t, g, unknown or other
  modified_base (368)..(368): a, c, t, g, unknown or other
  modified_base (396)..(396): a, c, t, g, unknown or other
  modified_base (424)..(424): a, c, t, g, unknown or other
  modified_base (506)..(506): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctacttagcctggtancagcagaaaccagggaaacgcccctaactctgatccatactgcatccagcttgacaaagtgggtcccatccaaggttcagcggcaagtggaatcgtgggactagatttcacttcncaccatcagcagcctgcagcctgtaagnttttagactaacttactattgtacaacnggcctgtccggtttccctggaccgttcggccgaaagggaccaaagggttaggaaactacgaaaccggttacttacgtggtcncggcaccttatcttgttccc

SEQ ID NO: 390098 - DNA, 627 bp, Homo sapiens
  misc_feature: GZ8MTXP01CXXW4.8.80.H03.1.454.CMB.2.raw
  modified_base (195)..(195): a, c, t, g, unknown or other
  modified_base (220)..(220): a, c, t, g, unknown or other
  modified_base (252)..(252): a, c, t, g, unknown or other
  modified_base (275)..(275): a, c, t, g, unknown or other
  modified_base (406)..(406): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttggtcgggnagtcgagggtatagcagctacttagctggtancagacaagaaaccgagggaaacnccccctaactcctagactccatactgacactccagtcttagacgtaaaggtcggggtaccctatacccgaagggttcaggccggactaaggtgggaatcgtagggactagtcttacactctacacatcacncacgctgcacgctagaacttatttcgacttaaacttactattcgtaacacgtacggtccgttaccggttcccggtttacccgttacggggtacccggtttcgggaacccggtaaacgggggttaacccgtaaaggggttcgtaaaaacgtccggttaaaaacccggttgttacgggtaagggtaacctcggaccctacgttactttccgttcgtttaaccc

SEQ ID NO: 390099 - DNA, 628 bp, Homo sapiens
  misc_feature: GZ8MTXP01ANH3I.8.80.H03.1.454.CMB.2.raw
  modified_base (252)..(252): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctacttagctggtancagcagaaaccagggaaacgcccctaacctcctgactccatactgcatccagtcttagacgtaaaggtcgggggtacccagtacccgaagggttcaggtcgggcgaagggttgggaactcgtagggggactaggtacttttccacttcctaccacctatcgaagccacgtccctggccacggcctagtaacgtattttacgacttaaactttacttattacgtacaacgtacggtcgttcggttcccggtttcccgttagggtacccgtttccgggaaccgaaaggggttacccgtaaagggttacggaaaactacgaaaacggttaacttcggtaacggcgttaacggaccacccgttattccgttcgtttaacc

SEQ ID NO: 390100 - DNA, 718 bp, Homo sapiens
  misc_feature: GZ8MTXP01DCOS3.8.80.H03.1.454.CMB.2.raw
  modified_base (195)..(195): a, c, t, g, unknown or other
  modified_base (248)..(248): a, c, t, g, unknown or other
  modified_base (268)..(268): a, c, t, g, unknown or other
  modified_base (364)..(364): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcggcagtcagggtatagcagctactagctgtancagcagaaaccagggaaacncccctaactcctagactccatactgacatccagtcttagacgtaaaggtcggggtacccattacccgaaaggttcaggccggacaaagggttcggngtaccgtaggggaaacctaggtactttcaactcctacaaccataccagccaacggccctaggaccgacgtaccgttaagaaacgtttactttttacgaaccgtttaaacccttttaatttaaacgttaccgttaaccgaaaaccggtcgggttcccgtttaccggggtttcccccgggtttttaccccggttacggggtaacccgggtttacccggggtaaacccgggaaaacggggttaaacccggttaaacggggttaaaggtaaaaaccgtaaccggttaaaaaacggttaccgttaggggttcgggtaaccttcggtaacccaaccgttacttcgtttcggtttaacccc

SEQ ID NO: 390101 - DNA, 688 bp, Homo sapiens
  misc_feature: GZ8MTXP01CLK2G.8.80.H03.1.454.CMB.2.raw
  modified_base (225)..(225): a, c, t, g, unknown or other
  modified_base (261)..(261): a, c, t, g, unknown or other
  modified_base (287)..(287): a, c, t, g, unknown or other
  modified_base (299)..(299): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctagtaggagacagacgtcaccatctacgttggtcgggnagtcgagggtattagcagtctacttagccgtggtancagacaacgaaaccgaagggaaaccncccctaactccngactccatactgctactccagtctacgacgtaaacggtcgggtacccagtacccgtaaggttcgacggcggacgaagggttggtaacgtcggtaagggactacgttactttaccgacctcctaccaacctactcgaacgcgaccggtcccgtagaccgtacgtccgtaagttaaacgttacttttaccggaacttaaacttttacgttagttaccgtaacgtaaaccgttggtcccgtttccggttaccccggttttccgtacgggtaccggttccgggaaacccggtaaacgggaccggtaaagggttacgtaaaaccgtaccgttaaacggttacgttcgggtccgacgtaacgtaaccctagttaccttaagttccgtttaacccg

SEQ ID NO: 390102 - DNA, 705 bp, Homo sapiens
  misc_feature: GZ8MTXP01DHS7V.8.80.H03.1.454.CMB.2.raw
  modified_base (303)..(303): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcattctggtaggagacgagtcaccatctacttaggtcgggcggagtacgagggtagttagcacgtactacttagcctggtatcagcaagaaaccgaacggaacgtcccctaaccctctanactccactactcgctactaccgtacgtctttacgacggtaaagttaccgggggtccccataccggtaaacggtttccgacggccgggtacgacggttaagggtcgtaacggtcgggtaaaccgtaagttacttttaccacgtttccaccctacccaattacgacgcgaacgtcccgtagacgacgtccgtaagtagttactttataaccgttaactttaactacgtttagactaacgacggtcttacggttcccggttttaccgttccgggttaacggttcccggtaacggtaaccggtaaaccggttaaagggttaacgttaaacgtaaaccgtaaacgttaaacccgttggttacgcggttacaaccgtaccgtagttacctttcggttctttaaccccg

SEQ ID NO: 390103 - DNA, 790 bp, Homo sapiens
  misc_feature: GZ8MTXP01ATF5B.8.80.H03.1.454.CMB.2.raw
  modified_base (252)..(252): a, c, t, g, unknown or other
  modified_base (273)..(273): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttgcgggcagtcagggtatagcagctacttagcctggtancagacagaaaccgaggaaacnccccgtaacctcctgactccatactgcactccagcgttagacgtaaacggtcgggggtacccagtacccgaacgggtttcgaggccggacgtaacgggtgggtaagtacccgtggggaaacctaggtacttttaccaccttccttaccaaccctacttacgacgccgtacggtacccttggaccacggtacccgttaagttaaacggttacgttttttaaccggtaaccgtttaaacccgtttttaacctttaacgttttaacggttaacccgtaaaacccggttaacgggttccgtttaaccccggggtttccccgggtttttaccccggtttacgggggttaaccccggggttttacccggggaaacccgggtaaaccggggggttaaacccggtaaaacgggggttacgggtaaaaaccgttaaccggttaaaaaccgggttaacgttacggggttaacggtaccgtaacgggttacccgaacccttaacgtttccgttccggttttaaccccg

SEQ ID NO: 390104 - DNA, 793 bp, Homo sapiens
  misc_feature: GZ8MTXP01BZDJS.8.80.H03.1.454.CMB.2.raw
  modified_base (197)..(197): a, c, t, g, unknown or other
  modified_base (223)..(223): a, c, t, g, unknown or other
  modified_base (282)..(282): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtcctccattcttccgtgtctgcatctgtagganacagagtcaccatcacgttggcgggngagtcgagggttatagcagcttacttagcctggtatcagacaagaaaccgagggaaacncccctaacctctagactccatactcgacactccagtcttagacgtaaacgggttcggggtacccctagtacccgtaacgggtttcgaacgggtccgggacgtaaagggttacgggtaacgttaccgggtaagggggaaccttaacgggttaaccgtttttaccccgaaccgtttaccccttaacccgaaaccctaacgttacccgaacggtaccctaaaccgggtccccttagggaccccgtaacggtacccgttaaggtaaacgtttacgtttttaacggaaacctttaaaaccgtttttaacgtttaacgtttacggttaaaccgtaaacccggttgggttacccgtttaccgggtttcccggttttccgttaccggtttacgggtacccgggtttaaccgggaacccggttaaacggggtacccgttaaagggtacggtaaaacttaaccggaaacgttaccggttggtacggtccgttacggaccttacctaactttccgttaaccg

SEQ ID NO: 390105 - DNA, 626 bp, Homo sapiens
  misc_feature: GZ8MTXP01CXQ2S.8.80.H03.1.454.CMB.2.raw
  modified_base (255)..(255): a, c, t, g, unknown or other
  modified_base (279)..(279): a, c, t, g, unknown or other
  modified_base (358)..(358): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaaccatcacgttgtcgggcagtcagggtattagcagctacttagcctggtancagacaagaaaaccagggaaaccnccccctaaactcctagactccaatactgacatccaagtctagactaaaggtcgggtcccagtccgaaaggtcaggcggnaaggtgaatcgtgggaactagtacttcactctcacagtcagcacgcctgacagcctaagaagttactttacgaacttaactttactattacgtaaccaaacgtcggtcctttaccgggtaccccgtttttcccgtaggggttacccggttaccgggaaaccgtaaagggggacccgttaaaagggttcggtaaaaaacgtcgaaaaacggttccgttagggttaacggaccttcggaaccctacgttacttccggttaagtttccccg

SEQ ID NO: 390106 - DNA, 537 bp, Homo sapiens
  misc_feature: GZ8MTXP02H1EWT.8.80.H03.1.454.CMB.2.raw
  modified_base (195)..(195): a, c, t, g, unknown or other
  modified_base (349)..(349): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggttattagcagctacttagcctggtatcagcagaaaccagggaaacgcccctaaacctcctgatccatactgcatccagcttgacaaagtcggggtccatccaaggttcagcggcagtggntcgtgggacagtatttcactctcacatcagcagctgcagcctgaagtattttgactaactttattattgtacaacaggcttcggtccgtttcccgtgggtaccgtttcggaccgtaaaggggaccgaaagggttacggaaaacttacgaaaacgtacgtggtcggctacgcaactactcgttacttcc

SEQ ID NO: 390107 - DNA, 593 bp, Homo sapiens
  misc_feature: GZ8MTXP02F87G5.8.80.H03.1.454.CMB.2.raw
  modified_base (194)..(194): a, c, t, g, unknown or other
  modified_base (590)..(590): a, c, t, g, unknown or other
tcagctcgcgtgtccacgaccggtgctcgatttagctgtgcgtcgaagggaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcgagtcagggtattagcagctacttagcctggtatcagacaagaaaccgaagggaaacgcccctaacctcctagactccatactgcatccagtcttagactaaaggtcggggtacccagtaccgtaaagggttccaaggcgggacgtaaggttagggtacgtccgttagggggaacctaagtacttttacaccttcctaccacccatacaagcagcctacgcacgcctagtaagttatttgacttaaactttatattacgtacaaacgtggcttcggtacccgtttccgtagggtaccgttcggaccgtaaagggaccgtaaaggtaacggaaactacgaaaacgacttaggcggactcgaccactatcctnttc

SEQ ID NO: 390108 - DNA, 604 bp, Homo sapiens
  misc_feature: GZ8MTXP02H6K1O.8.80.H03.1.454.CMB.2.raw
  modified_base (178)..(178): a, c, t, g, unknown or other
  modified_base (195)..(195): a, c, t, g, unknown or other
  modified_base (287)..(287): a, c, t, g, unknown or other
  modified_base (351)..(351): a, c, t, g, unknown or other
  modified_base (379)..(379): a, c, t, g, unknown or other
  modified_base (391)..(391): a, c, t, g, unknown or other
tcagctcgcgtgtccacgaccggtgctcgatttagctgtgcgtcgaagggaaaggagtcagacccagtcaggacacagcatggacatgagggtcccccgctcagctcctggggctcctgctgctctggttcccaggttccagatgcgacatccagatgacccagtctccatcttccgngtctgcatctgtagganacagagtcaccatcacgttggtcgggcagtcagggttattagcagctactagctggtatcagcagaaaccagggaaacgcccctaacctccngactccatactgcatccagcttgacaaaggtcgggtaccatccgaaggttcaggcggcaggtgntcgtaggactagtattcactctaccacntcagcagcctanctagcctagaagtattttacgaccttaaactttacctagttacgtacctaaacgaacggtcgttaccggtcccggttttacccgtaggggttaacccgttaccgggggtaacaaaacgggggtacccgtaaaggttaaaccggaaaacgttaaccgaaaacggtacttaggttaacggcgtaacggaccctacgtacttacgttcgttaaccc

SEQ ID NO: 390109 - DNA, 590 bp, Homo sapiens
  misc_feature: GZ8MTXP02I1V1J.8.80.H03.1.454.CMB.2.raw
  modified_base (272)..(272): a, c, t, g, unknown or other
  modified_base (350)..(350): a, c, t, g, unknown or other
  modified_base (354)..(354): a, c, t, g, unknown or other
  modified_base (404)..(404): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcagggtattgcagctactagcctggtatcagcaagaaaccagggaaacncccctaacctcctagactccatactgcatccagcttgacaaagtcgggtacccagtaccgaaggtcagcggcaggtgntcgngggactagtatttcactctacacctatcagcagctgcagcctagaagttntttagaccttaacgttactattacgtaccaaagcggtcctcggtcccggttttccgttacggggaccgtttaccgggaccggtaaaacggggtacccgaaaagggttacggaaaacgttaaccgaaaaacgtaccgttaggttcgggacttaccggacctaccctaaggttccttacggtttaccc

SEQ ID NO: 390110 - DNA, 765 bp, Homo sapiens
  misc_feature: GZ8MTXP02IJKE4.8.80.H03.1.454.CMB.2.raw
  modified_base (195)..(195): a, c, t, g, unknown or other
  modified_base (311)..(311): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcgagggttattagcagtctacttagcctggtatcagacaacgaaaccgaagggaaaccacccctaaacctcctagactaccatacngcactccagtcttagacgtaaacgggttcggggtaccccaagtaccccgtaaacgggttcgacggtccggacgtacgggttaggtacgttacggtaacgggggtaacctaacggttaacctttttaccaacccttttcccaacctaaccctaacgtacccgacgtaccgacccgtacccgtacgaccgtaacggtacctaggtaaacgtttacgtttttacgaacctttaaaactttttacttaacgtttcgtaaccctaaacggtacggttccgtttaccgggtttaccccggtttttacccgttcgggtaacccggtttacccggggaacccgtaaaacgggggtaacccgtaaaagggttaaaccggtaaaaacgttaaccgaaaaaccgttacgttacgggtaacggtaccgtacggtaccctaactacgtttaccgtttcgtttacccg

SEQ ID NO: 390111 - DNA, 501 bp, Homo sapiens
  misc_feature: GZ8MTXP02FF9PT.8.80.H03.1.454.CMB.2.raw
  modified_base (313)..(313): a, c, t, g, unknown or other
  modified_base (416)..(416): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctacttagcctggtatcagcagaaaccagggaaagcccctaaactcctgatccatactgcatccagcttgcaaagnggggtcccatccaaggttcagcggcagtggatctggggacagatttcactctcaccatcagcagccctgcagcctgaagattttgctaacttactatttgtanaaccaggctgtccggtttccctggacgttcggccaagggaccaaacggtggaaatcaaacgaactgtggctgcaccatcctgtcc

SEQ ID NO: 390112 - DNA, 573 bp, Homo sapiens
  misc_feature: GZ8MTXP02J09JQ.8.80.H03.1.454.CMB.2.raw
  modified_base (195)..(195): a, c, t, g, unknown or other
  modified_base (222)..(222): a, c, t, g, unknown or other
  modified_base (396)..(396): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcactttggtcgggnagtcagggtattagcagctacttagcctggtatcagcaagaaaccgagggaaacgcccctaacctcctcgatccatactgacatccagcttgacaaacggtcggggtcccatccgaaggttcaggcgcaggtggatcgtagggacagtactttcactctcaccatcagcagctncagcctagaagttattttgactaacttattattcgtacacgacggtccttcggtcccggtttcccgtgggtacccggtttccggaaccgaaacggggacccaaaggggttacggaaaacgtacgaaaccggtaacgtggttcggcctacgaccgaacctacgttcgtacgtttcccg

SEQ ID NO: 390113 - DNA, 562 bp, Homo sapiens
  misc_feature: GZ8MTXP02I4P5L.8.80.H03.1.454.CMB.2.raw
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtattagcagctactagcctggtatcagcaagaaaccagggaaacgcccctaacctcctagactccatactgcatccagctgacaaagtcggggtcccatccgaagttcagcggcaggtgatcgtgggacagatttcactctcaccatccagcagcctgcagcctgaagtatttacactaaactttactaattcgtacaaagtcggtcttcggtcccggtttcccgtgggtaaccgttcggaaccgtaaacggggaccgtaaagggtaacggaaacgtaccgaaaaccgtaacgtggtaacggtctacggacctaccacttacgtctttcccg

SEQ ID NO: 390114 - DNA, 528 bp, Homo sapiens
  misc_feature: GZ8MTXP02IXG6N.8.80.H03.1.454.CMB.2.raw
  modified_base (355)..(355): a, c, t, g, unknown or other
  modified_base (432)..(432): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcgagggttattaggcagctacttagcctggtatcagcagaaaccagggaaacgcccctaacctcctgatccatactgcatccagtcttgctaaaggtcggggtacccagtccaaggttcagcggcagttgntcgtgggacagtattcactctacacatcagcagctgcagcctgaagtatttgactaacttactattgtaccaaacgngtctgtaccggtttccttaggacgttcggaccgaagggaccaagggtagaaactacgaaaacgtcgtagtcggactcggacacgtctacgtcgttc

SEQ ID NO: 390115 - DNA, 566 bp, Homo sapiens
  misc_feature: GZ8MTXP02FPWIZ.8.80.H03.1.454.CMB.2.raw
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctacttagcctggtatcagcaagaaaccaggaaacgcccctaacctcctgactccatactgcatccagtcttgacaaaggtcggggtaccataccgaaggttcaagcggcaggtggatcgtgggacagtattcactctcaccatccagcagcctgcagcctagaagttattttacgactaaacttactattacgtacaaacgcggtcttcggttacccggtttcccgttagggtaccggtttccggaaccgaaacggggaccctaaaggggtaacgtaaaactacgaaaacgtactaggtcgctacgacaccgtatccgtagtttaccc

SEQ ID NO: 390116 - DNA, 749 bp, Homo sapiens
  misc_feature: GZ8MTXP02JSPMX.8.80.H03.1.454.CMB.2.raw
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcgagggtattagcagctacttagcctggtatcagcaagaaaccgagggaaaccgcccctaacctccagactccatactgcactccagtcttacgacgtaaaggtccggggtacccaagtacccgtaacggttcgaacggtcgggacgtagggttagggacgttccggtagggggaactagttactttaccaccttcctaccaccctatccgacgccaacgtcccgtagaccgtacggtacccgttaagtaaacgtttacttttacggaaaccctttaaaccgttttaaacttaacgttttacgggtaaccgtaaaaccgtacgggttacccgtttaccggggttcccccgggtttttacccgggtttacggggttaacccgggttacccggggtaacccgggaaaaccgggggtaacccgtaaaacgggggtacggtaaaaaccgttaaccggaaaaccggtaacggttacgggtaaccggtacgttaaccggacctaaccctacgtttaccgttcgtttacccg

SEQ ID NO: 390117 - DNA, 551 bp, Homo sapiens
  misc_feature: GZ8MTXP02FKN4E.8.80.H03.1.454.CMB.2.raw
  modified_base (195)..(195): a, c, t, g, unknown or other
  modified_base (526)..(526): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggtattagcagctacttagcctggtatcagcaagaaaccgagggaaacgcccctaaacctcctagactccatactgcatccagcttgacaaagtggggtccccatccgaaggttcagcggacagtggatcgtggggactagatttcactctcacatcagcagcctgcacgcctagaagtattttgactaactttactattacgactaaccgaggtcttcggtcccggtttcccttagggtaccgttccggaccgtaaagggacccgtaaagggtacggaaactacgaaaacgacgttagnggctacgactaccagtcctgttacc

SEQ ID NO: 390118 - DNA, 611 bp, Homo sapiens
  misc_feature: GZ8MTXP02HSSH8.8.80.H03.1.454.CMB.2.raw
  modified_base (197)..(197): a, c, t, g, unknown or other
  modified_base (401)..(401): a, c, t, g, unknown or other
tcagctcgcgtgtccacgaccggtgctcgatttagctgtgcgtcgaagggaaagggagtcagacccagtcaggacacagcatggacatgagggtcccccgctcagctcctggggctcctgctgctctggttccccaggttccagatgcgacatccagatgacccagtctccatcttccgtgtctgcatctgtagganacagatcaccatcacttggtcgggcgagtcgagggttattagcagctacttagcctggtatcagacaacgaaaccaaggggaaacgccccctaacctcctgactcatactgcatccagtcttagacgtaaaggtcggggtaccccatcccgtaaaggttcagcggcaggtgagtcgtagggacagtaacttcacttcctcaccntacagcacgcctgcacgctagtaagttactttcgacttaaacgtttattagttacgtaacaacggacgtcgtaccgttcccgggtttacccgtcgggtaccgttccggaaacggtaacggtaaccggtaagggtaaacggtaaaactaacggtaaaaccgtacgtacggtaagggtctacggtacctaccgtacgttccttacgtttccc

SEQ ID NO: 390119 - DNA, 614 bp, Homo sapiens
  misc_feature: GZ8MTXP02FNTJ7.8.80.H03.1.454.CMB.2.raw
  modified_base (195)..(195): a, c, t, g, unknown or other
  modified_base (260)..(260): a, c, t, g, unknown or other
  modified_base (279)..(279): a, c, t, g, unknown or other
  modified_base (492)..(492): a, c, t, g, unknown or other
tcagctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcgaggtcgagggttattagcagcttacttagcctggtancagcaagaaaccaggaacncccctaactctagactccatactgcactccaagtcttaggacctaaaggtcggggtacccaagtcccgtaaaggttcaacggtcggacgaggttggacgtcggtaggggaacaaggttactttcaaccttctactacactacgaacgcaacggtcctacgccgagtcctaggtaacttatttcgaacttaacttacttagttcgactaaacgnggtcctacggttcccgtttccgtaggtaccgggttacgaccgaaggggacctaaagggtagaaaacttaaccgaaaacgtaccgtaggtcggaccacggtactacgtactccgtctttaccc

SEQ ID NO: 390120 - DNA, 741 bp, Homo sapiens
  misc_feature: GZ8MTXP02FHGLK.8.80.H03.1.454.CMB.2.raw
  modified_base (199)..(199): a, c, t, g, unknown or other
tcagctcgcgtgtccacgaccggtgctcgatttagctgtgcgtcgaaggggaaagggagtcagacccagtcaggacacagcatggacatgagggtccccgctcagctcctggggctcctgctgctctggttccccaggttccagatgcgacatccagatgacccagtcctccattcttccgtgtctgcatctgtagganacagagtccaccatcacttggtcgggcgagtcgagggtattaggcagctacttagcctggtatcagacaagaaaccaagggaaaccgaccccctaaacctccctagactaccctaatactgacactacccagtcttagaccgtaaacggtcggggtcccctaagtacccgaaacgggtttcacggccgggacaggttggtacgtcgtacggggactagttattttaccgacttcctacctaaccctagttaccacgtacaacgtccctagacctacgcccttaggtaaacgttaagtttttacgaacctttaaaccgtttaacgttaaagtttacgttaaaccgaaaccgtacgggtaccttacgggtttaccccccggttttacccggttacgggggttacccgtttaacccgggaacccggtaaaacggggtaaacccgtaaaacgggggtaaacggttaaaaccgttaaaccgtaaaaacggtaaccgttaagggttcgacgttacggaaccctaaccgtacttacgtcggtttacccg

SEQ ID NO: 390121 - DNA, 718 bp, Homo sapiens
  misc_feature: GZ8MTXP01D4OEM.10.2.A02.1.454.CMB.2.raw
  modified_base (198)..(198): a, c, t, g, unknown or other
  modified_base (265)..(265): a, c, t, g, unknown or other
  modified_base (299)..(299): a, c, t, g, unknown or other
  modified_base (353)..(353): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacncgccaccctctcctgcagggccagtcagagtgtggcagcaggttagcctggtaccagcaagaaacgnggccaggcctccgaggctccgtgtatagtggtcncactcccaacgacgggcctacgtggtactcgtacgaggctacgggtttccccgnggcgtagggtcggggtcgtagggggaacaagggtacgtttccgacgttcgtacccaacctaagtccgagccgacggtcccgttggacctaaggttcgttaaggtaaagtttacgtttttacggacgtttaaggtttttaactttaccgttagggttaccgtaaggtaccttaaggttaaacttaaagtacgggtccgttaccggggacccccggtacgggtacccgggtttacccggggaaacccggtaaaacgggggtacccgggttaggggttaaccggttaaaacgtttaaccggaaaacggttacgttcggttacgggtaactcggtaaccaacctacgtttcgttcgtttccgttaaccg

SEQ ID NO: 390122 - DNA, 528 bp, Homo sapiens
  misc_feature: GZ8MTXP01DQ5MM.10.2.A02.1.454.CMB.2.raw
  modified_base (263)..(263): a, c, t, g, unknown or other
  modified_base (335)..(335): a, c, t, g, unknown or other
  modified_base (356)..(356): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgnggccaggctcccaggctcctcgtatatggtgcatccacagggccacgtggtatctcgaggcaggttccccgnggctaggtgggtctggggacnggagttcactgtcacatcagcagcctgcagtctagtaagtatttgctagtttattactggtcagtctaagtataagtagctacggcccgtgtacgttcggaccgaaaggggccgagggtagaaacgttacgaaacgttacgttggttagctagcaccgattctgttcttaac

SEQ ID NO: 390123 - DNA, 570 bp, Homo sapiens
  misc_feature: GZ8MTXP01D41CE.10.2.A02.1.454.CMB.2.raw
  modified_base (266)..(266): a, c, t, g, unknown or other
  modified_base (286)..(286): a, c, t, g, unknown or other
  modified_base (291)..(291): a, c, t, g, unknown or other
  modified_base (293)..(293): a, c, t, g, unknown or other
  modified_base (333)..(333): a, c, t, g, unknown or other
  modified_base (355)..(355): a, c, t, g, unknown or other
  modified_base (405)..(405): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccaccctgtctgtgtctccgaggggaaacacgcccaccctctcctgcgagggccagtcagagtgtggcagcaggttagcctggaccagcaagaacgngcaggctccagctctgtatntggtncntccacgagggccagtggtatctcgaggcgtaggttcccgnggctaggtgggtcgaggggacnggtagttcacgtgtaccacgtatcgagcagctgctagttctagtaagttntttgacttagtttattacgttggtacagtactagtaatagtacgcgtacggcccgtcgtaccggttccggaccggaacggggaccgttagggtacgttaaacgtaccgtaaacgttacgttggttcggtctcgcctacccgtattccgtaacgttcctttaaccg

SEQ ID NO: 390124 - DNA, 410 bp, Homo sapiens
  misc_feature: GZ8MTXP01B6IYS.10.2.A02.1.454.CMB.2.raw
  modified_base (391)..(391): a, c, t, g, unknown or other
  modified_base (395)..(395): a, c, t, g, unknown or other
  modified_base (399)..(399): a, c, t, g, unknown or other
  modified_base (406)..(410): a, c, t, g, unknown or other
tcagcatagtagtgcacgaccggtgctcgatttagactcatctacaggggagagtgttagagggagaagtgccccacctgctcctcagttccagcctgacccctcccatcctttggcctctgaccctttttccacaggggacctaccctattgcggtcctccagctcatctttcacctcaccccctcctcctccttggctttaattatgctaatgttggaggagggggtgaggtgaaagatgagctggaggaactgctcacttaggacccagacggaaccatggaagccccagcgcagcttctcttcctcctgctactctggctcccaggaactgtggctgcaccatctgtccttcatctcccgcaatctgacactactatgctgagcggntggnaggngcatagnnnnn

SEQ ID NO: 390125 - DNA, 568 bp, Homo sapiens
  misc_feature: GZ8MTXP01DZX3J.10.2.A02.1.454.CMB.2.raw
  modified_base (264)..(264): a, c, t, g, unknown or other
  modified_base (297)..(297): a, c, t, g, unknown or other
  modified_base (374)..(374): a, c, t, g, unknown or other
  modified_base (427)..(427): a, c, t, g, unknown or other
tcagcatagtagtgcacgaccggtgctcgatttagactcatctacagggggaggaactgctcacttaggacccagacggaaccatggaagcccagcgcagcttctcttcctcctgctactctggctcccagataccactggagaagtagtgatgacgcagtctccagccaccctgtctgtgtctccgaggggaaacacgccaccctctcctgcagggccagtcagagtgttggcagcaggttagcctggtaccagcagaaacgnggccaggcctccgaggctccgtgtatagtggtncactccacgagggccacgttggtactcgtacgaggtctacgggttccccgtggcgtagggtcgggtcgtaggggacngggtacgttcgacgttcgtaccaccgatcgagcaggcctgacagtcagtaatntttgacttagtttatacgtggtcagtactaagtataagtcgcgtcggcccgtcggtacgtccggacgaaaggggcgagggtagaaacgttaccgaaagttcgttggttacggcctaggcctacgattccgttgttcttccg

SEQ ID NO: 390126 - DNA, 591 bp, Homo sapiens
  misc_feature: GZ8MTXP01C15K5.10.2.A02.1.454.CMB.2.raw
  modified_base (262)..(262): a, c, t, g, unknown or other
  modified_base (426)..(426): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcaagaacgnggccaggctcccgaggctcctgtatagtggtgcatcccaccgagggccacgttggtactcgtcgaggctacggggttccccgtgggcgtaggtcggggtctagggggactggagtttccgaacgttcgtaccaacctagtcagcagcctgcagtctagtaagtntttgcttagtttatacgttggttacagtactaagttataagtacgcgtacgggccccgtacggtaccggttccgggcccgtaaaggggacccgttagggttacggaagtttaacgaacgttaacgttggttacggctagcaccgtattcgttcgttcctttaacg

SEQ ID NO: 390127 - DNA, 675 bp, Homo sapiens
  misc_feature: GZ8MTXP01AW6VF.10.2.A02.1.454.CMB.2.raw
  modified_base (197)..(197): a, c, t, g, unknown or other
  modified_base (264)..(264): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacngcccaccctctcctgcagggccagtcagagtgttggcagcaggttagcctggtaccagcagaaacgnggccaggcctcccaggcctcctcgtatagtggtgcactcccaaccgacggggcccacgttggtactctcgagggtcgtacgggtttccccgtgggcgtagggtggggtctagggggaacaaggtagtttccaacgttcgtaccaacccattccgaacggccaacggtcccctagggcctaaggttaccgttagggtaaacggtttattttttgggactttaaggtttttaatttaccgttggggttacaaggtacttaaaggttaattaaagttacggccgttaccggggccccgtacgggtacccggttccggggacccggtaaacggggaccggttaggggtacggttaaacgttaacgaaaacgttacgttgggttacggctacgcacctattccgtcgttcttaacg

SEQ ID NO: 390128 - DNA, 409 bp, Homo sapiens
  misc_feature: GZ8MTXP01C7SOB.10.2.A02.1.454.CMB.2.raw
  modified_base (284)..(284): a, c, t, g, unknown or other
  modified_base (405)..(409): a, c, t, g, unknown or other
tcagcatagtagtgcacgaccggtgctcgatttagactcatctacaggggagagtgttagagggagaagtgccccacctgctcctcagttccagcctgacccctcccatcctttggcctctgaccctttttccacaggggacctacccctattgcggtcctccagctcatctttcacctcaccccctctcctccttgcttaatatgctaatgttggaggagggggtgaggtgaaagatgagctggaggaactgctcacttaggacccagacggaaccatggaanccccagcgcagcttctcttcctctgctactctggctcccaggactgtggctgcaccatctgtccttcatcttcccgcaatctgacactactatgctgagcgggctgggcaaggcgcatagnnnnn

SEQ ID NO: 390129 - DNA, 742 bp, Homo sapiens
  misc_feature: GZ8MTXP01C1DQ9.10.2.A02.1.454.CMB.2.raw
  modified_base (233)..(233): a, c, t, g, unknown or other
  modified_base (237)..(237): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcgagtgtgtgngagngtaggtacgcgtacgacagacgaagaacggcgacgacggccctaccgacggtcctccgtagtataggtggtcacacctaccgacggacggcctacggttggtactcgtacggacggtcgttacgggttcccggtcggacggtaggggtcgggtcggtaacgggaacgtaagggttacttaccgtacgttaccgaccaaccgtacgtcggaacgccgtaccgtccggtaggaccgttaacggtgttaaaggtaagtttttcgtttacgacgttttaaatttttaaccgtcgttaggtaacgaacggttaataaagtttaaactaacggtccggtccggttaccccggggacccggttaacggttacccggggtaccgggaaaccggggtaaaacgggggtccgttaaagggggttaaaccttaacgttaaaacccgggaacgttacggttggggttacctcgtacgaacccttaaacgttcgttcgttaacccggttcttaacccg

SEQ ID NO: 390130 - DNA, 705 bp, Homo sapiens
  misc_feature: GZ8MTXP01BBGPY.10.2.A02.1.454.CMB.2.raw
  modified_base (261)..(261): a, c, t, g, unknown or other
  modified_base (292)..(292): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggaacagccaccctctcctgcagggtcagtcagagtgttggcagcaggttagcctggtaccagcagaaacgnggccaggctccaggctcctcgtatatggtcncactcccaaccgacggggcctaacgtgggttactccgtcgaaggggtctacggggttttccccccggtagggccgtaggggttcgggggtccgtaacggggggaacctaagggtacgttttaccgaccgttcgggtacccaacccgtaattcccgaacggtccaacggtcccttcggaccgtaaggtttacccgtagggttaaacgttagttttttcggaacctttaagggtttttaaactttaccgttggggttaccctaaggtacctaaaggtttaataaacgtacggtcgttacgggccccgtacggtaccggttccgggacgtaaaggggcccgttagggtacggaaacttacgaaacggttaacgttgggttcggaacttggaacctactagttcctgttccttaacg

SEQ ID NO: 390131 - DNA, 727 bp, Homo sapiens
  misc_feature: GZ8MTXP01AZQQY.10.2.A02.1.454.CMB.2.raw
  modified_base (204)..(204): a, c, t, g, unknown or other
  modified_base (232)..(232): a, c, t, g, unknown or other
  modified_base (252)..(252): a, c, t, g, unknown or other
  modified_base (315)..(315): a, c, t, g, unknown or other
  modified_base (368)..(368): a, c, t, g, unknown or other
  modified_base (408)..(408): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggaacagccaccctntcctgcagggccagtcgagtagtgtgcngcgtaggtacgcgtacgacngacgaacgtaacggcggaccgaggtcctccgacggtcctccgtcgttaatggtggtcactacncccacggacggacctacgttggtacttcacgacggcgtcggttccccggtggngtacgggttcggggtcgtaagggacctaaggtcgttaacncgttcgaccaactacaccgaggccaacgttcccggtcgtacgttagtacggtaagtttaagttttcgttacgtacgtttttaaggtttacttacgtacgggtacgtaacgttaacgttaaagtttaaacgttaacggtccggtaccgggttccccggtaaccgggtaaccggggttaccgggtacccggggaaacggggtaaaccgggggtacgggttaaagggtaaccgttaaacgttaaaacccggaacgggttcgttcggggttaccgtaactacgaacccgttacgtccgtttcgttccgttaaccgtttaaccg

SEQ ID NO: 390132 - DNA, 713 bp, Homo sapiens
  misc_feature: GZ8MTXP01A2MGU.10.2.A02.1.454.CMB.2.raw
  modified_base (243)..(243): a, c, t, g, unknown or other
  modified_base (262)..(262): a, c, t, g, unknown or other
  modified_base (295)..(295): a, c, t, g, unknown or other
  modified_base (341)..(341): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttancctggtaccagcagaacgnggccaggcctcccaggctcctcgtatagtggtncactcccaccgagggccagtggtatctcgaggctagggttccccgngggactagggttcggggtccgtagggggaacctaagggtacggtttaccaccgttcggtaccaacccgtatccgaacggccaacggtccccgttggacccttaagggttacccgttaaggtaaacggtttaagttttttcgggacctttaagggttttaactttaaccgttgggggttaccaagggtacctaaaggttaaattaaacgtcggtaccgttcggggacccccgtacgggttacccggtttaccggggacccggtaaacgggggacccggttaggggttaacggttaaacgtttaaccggaaaacggttaaccgttgggttacgggccctggaacctacccgtagttcctcggttaactttcccg

SEQ ID NO: 390133 - DNA, 517 bp, Homo sapiens
  misc_feature: GZ8MTXP01B87GC.10.2.A02.1.454.CMB.2.raw
  modified_base (241)..(241): a, c, t, g, unknown or other
  modified_base (261)..(261): a, c, t, g, unknown or other
  modified_base (317)..(317): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgtggcagcaggttancctggtaccagcagaaacgnggccaggctccaggcctcctcgtatatggtgcatccacagggccacgtggtactcncaggcaggttcccccgtggcaggtcggggtctggggacctggagttcacgttgtccacatcagcagctgcagtctgaagtatttgctagtttatactggtcagtcagtataatgctggcccgtgacgttcggccgaaacggggcgagggtgaaagttacgaaacgttagttggttacggctggcacattctgttcttaac

SEQ ID NO: 390134 - DNA, 604 bp, Homo sapiens
  misc_feature: GZ8MTXP01D4KVM.10.2.A02.1.454.CMB.2.raw
  modified_base (198)..(198): a, c, t, g, unknown or other
  modified_base (303)..(303): a, c, t, g, unknown or other
  modified_base (358)..(358): a, c, t, g, unknown or other
  modified_base (589)..(589): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacncgcccacctctcctgcagggccagtcagagtgtggcagcaggttagccgtggtaccagcaagaaacgtggaccaggcctcccgaggcctcctcgtatagtgggtncactcccgaaccgagggcctacgttggtactcgtcgaggcctacgggttccccgngggactagggtcgggtcgtagggggactgggtacgttccgacgttcgtaccaaccgtatcaggcacggcccttaggctaggttctagtaagttctttagcttagtttacttctggtcaggtactagtaataagtcgcgtcggcccgtggtaccgttcgggaaccggaagggtccggaagggttcggaaacttaacgaacgggttacgttggacggtctacggctaaccgtnttcgttcgttccgtc

SEQ ID NO: 390135 - DNA, 618 bp, Homo sapiens
  misc_feature: GZ8MTXP01B39Z6.10.2.A02.1.454.CMB.2.raw
  modified_base (272)..(272): a, c, t, g, unknown or other
  modified_base (365)..(365): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaaggggaaacacgcccaccctctcctgcagggccagtcagagtgttggcagcagggttagccgtggtaccagcgaagaaacggnggccaggcctcccgaggtcctccgtgtatagtggtgcactcccgaaccgaggggccctaacgtggtactcgtacgaggcgtagggttccccgnggcgtaggtggggtcgtaggggactggtacgtttcacgttgtaccgacggtatcagcagcgtgcagtctagtaagttatttgacttaagtttattactggtcaagtctaagtaataagtacggtcgtacgggcccgtacggtaccggttccgggaaccgtaaacgggggaccggttagggtacgttaaacgttaacgaaaacgttacgttggttacggctcggaactaccgattccgttaagttccgttaacg

SEQ ID NO: 390136 - DNA, 586 bp, Homo sapiens
  misc_feature: GZ8MTXP01DILPV.10.2.A02.1.454.CMB.2.raw
  modified_base (263)..(263): a, c, t, g, unknown or other
  modified_base (294)..(294): a, c, t, g, unknown or other
  modified_base (343)..(343): a, c, t, g, unknown or other
  modified_base (426)..(426): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccaccctgtctgtgtctccgaggggaacacgccaccctctcctgcgagggccagtcagagtgtgcagcaggtgccgtggtaccagcaagaacgnggccaggcctccaggctcctcgtatatggtncatccacgagggccacgtggtatcgtcgaggctacgggtttcccccggnggacgtgggttcgggtcgtagggactggtacgttccacgtcgtaccactatacacgcacgtcctgactagtacgtagtagttntttgacttagtttacttacgtggtacagtactagttaatagtcgtcggtccggccgtcggtaccggtccgggaacggtaacggggtcgttagggtacgttaaacgttaacgaaacgttacgttggttacgctacgaacctacgtcgttcttcgttcctcg

SEQ ID NO: 390137 - DNA, 655 bp, Homo sapiens
  misc_feature: GZ8MTXP01A40QQ.10.2.A02.1.454.CMB.2.raw
  modified_base (264)..(264): a, c, t, g, unknown or other
  modified_base (270)..(270): a, c, t, g, unknown or other
  modified_base (275)..(275): a, c, t, g, unknown or other
  modified_base (281)..(281): a, c, t, g, unknown or other
  modified_base (285)..(285): a, c, t, g, unknown or other
  modified_base (323)..(323): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtcctccgaaggggaaacacgcccaccctctcctgcgagggccagtcagagtgtgcagcaggtagcctggacagcaagaacgngcagcncagcnctgtanatgncatccacgaggccatggtatctgaggtcaggttcccgnggcgaggtcggggtctagggggaactaaggtacgtttaccacgttcgtaccaaccgtatcgaacgcaacgcctggctaaggttcgtagtaaagttattttcgagttaagttttattacgttggttacgaagtactaaagttaaagtaaagtacgtccgtaccggggtcccgtaacgggtaacccgggttcccgggaaaccgggtaaaacgggggtaacccggttaaggggttaaacggttaaaacgtttaaaccggaaaaaacggttaccgttgggttacggtccttacggaaccctacccgttattcccgtttaagttcccgtttaacccg

SEQ ID NO: 390138 - DNA, 731 bp, Homo sapiens
  misc_feature: GZ8MTXP01CVOEE.10.2.A02.1.454.CMB.2.raw
  modified_base (272)..(272): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacagcccaccctctcctgcgagggccagtcagagtgttggcagcgaggttacgccgtaggtaccagacaaggaaacgnggccacggcctcccgaggcctccgtgtagtagtggtcacactcccgaaccgacggggccctacgttggtactccgtacgacggggtcgtacggggttcccccggtgggacgtaggggttcggggtccgtaaggggactaagggtacgtttccacgttgtacccaacctagtaccgagcctaacggcccgttaggaccgtaggtttacgtaagggtaaacgttttgtttttacgggacttttaaaggttttttaacttacgttacggggttacaacggttacgtaaagtttaagtaaacgtcggtccgttaccggggaccccgtacgggtaccgggttacccgggaacccggtaaagggggtacccgttaggggtaacgttaaacgtttaaaccggaaacgttacggttgggttacggccgttcggaaccctacgtacttcgttaacggttcctttaacg

SEQ ID NO: 390139 - DNA, 712 bp, Homo sapiens
  misc_feature: GZ8MTXP01CFFRU.10.2.A02.1.454.CMB.2.raw
  modified_base (280)..(280): a, c, t, g, unknown or other
  modified_base (346)..(346): a, c, t, g, unknown or other
  modified_base (367)..(367): a, c, t, g, unknown or other
tcagcatagtagtgcacgaccggtgctcgatttagactcatctacaggggggaggaactgctcacttaggacccagacggaaccatggaagccccagcgcagcttctcttcctcctgctactctggctcccagataccactggagaagtagtgatgacgcagtctccagcccaccctgtctgtgtctaccgaaggggaaacacgcccacccctctcctgcgagggccagtcagtagtgttggcagcagggttacgccgtaggtaccagcgaaggaaacgnggccaggcctcccgaggtcctccgtgtatagtggtgacactccacgagggcctacgttgtactcgngacggtcgtaggtttccccgngggactaggggtcgggtcgtaagggggaacctaagggtactttaccgaacgttcgtaccaacccaagtccgaagtccacggtccctggacctaggttactaggtaaaagttgtttttacggactttaaggtttttacttaacgttgggtactaaggtactaaagttaaataaacgttcggccgttaccgggaccccgtccgggtaaccggttcccgggaaccgggtaaaacggggaccgggttaaaggggtaacgggttaaaatttaacccggaaaagggttaacgtttgggcgggttaactcggtaaccctaacgtagttccctttaaggttcccgtttaaccg

SEQ ID NO: 390140 - DNA, 681 bp, Homo sapiens
  misc_feature: GZ8MTXP01A62DU.10.2.A02.1.454.CMB.2.raw
  modified_base (196)..(196): a, c, t, g, unknown or other
  modified_base (261)..(261): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggaaacngccaccctctcctgcagggccagtcagagtgttggcagcaggttagcctggtaccagcagaacgnggccaggcctcccaggcctcctcgtatagtggtgcactcccaacgagggcccacgtggtactcgtcgaaggtcgtacgggttccccgtgggcgtagggtcggggtcgtaagggggacctaagggtacgtttccgaccgttcggttacccaaccgtagtacccgaagcccaagggtccccttggaccgtaagttcgtaaggtaaaggttagtttttggaccttaaggtttttaacttaaccggttgggttacccgaaggtacctaaaggttaataaacgtacgtccgtacgggtccccgtacggtaaccggttccgggacccggaaaggggtacccgttagggttacggaaacgttaccgaaaacgttacgttggttacgggtaactcggaacctaaccgtattacgtcgttccttaaccg

SEQ ID NO: 390141 - DNA, 633 bp, Homo sapiens
  misc_feature: GZ8MTXP02GS0OD.10.2.A02.1.454.CMB.2.raw
  modified_base (224)..(224): a, c, t, g, unknown or other
  modified_base (231)..(231): a, c, t, g, unknown or other
  modified_base (233)..(233): a, c, t, g, unknown or other
  modified_base (247)..(247): a, c, t, g, unknown or other
tcagcatagtagtgcacgaccggtgctcgatttagactcatctacaggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcgagngtgtgcngngtagtcgcgtgacngcagacgcgacgacgcctccgagcctcgtcgtatagtggtcgactactacccacggacggcctacgttggtactccgtacgacggtcgttacgggttcccggtggacgtaggggtcgggtcggtagggaactaggttacgttactacgtcgtacccacgtactacgacgcgaccgtccgtacggacgtaacgttcgtaaggtaaagtttgtttacgacgtttaagttttaacttccgttgtacgtagtactaagttaataagtcggtcggtaccggacccgtacggtaccgggttccggaaccgggtaaacgggaccggtaggtaacggtaaactaacgaaaacgtacgtggtacggcgtacgacctacgtgttcgtcgttcctac

SEQ ID NO: 390142 - DNA, 553 bp, Homo sapiens
  misc_feature: GZ8MTXP02GPN4J.10.2.A02.1.454.CMB.2.raw
  modified_base (293)..(293): a, c, t, g, unknown or other
  modified_base (359)..(359): a, c, t, g, unknown or other
  modified_base (400)..(400): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctccaggctcctcgtatatggtncatccaccgagggccacgtggtactctcgaggctaggttccccgtggcaggtggggtctggggacnggtagttcacgtgtcacatcagcagcctgcagtctgaagtntttgctagtttatactgtcagctagtataagtagcgtcggcccgtggtacgttcgggaccgtaaacgggggacccgtaggggtacggtaaactttaccgaaaaccgtacgttggtacgggctacggaccaccgtatccttcggttcctttacg

SEQ ID NO: 390143 - DNA, 525 bp, Homo sapiens
  misc_feature: GZ8MTXP02J0V9B.10.2.A02.1.454.CMB.2.raw
  modified_base (335)..(335): a, c, t, g, unknown or other
  modified_base (353)..(353): a, c, t, g, unknown or other
  modified_base (439)..(439): a, c, t, g, unknown or other
tcagcatagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccgaggctcctcgtatatggtgcatccacagggccactggtatctcaggcaggttccccgnggcagtgggtctgggacngagttcactgtcaccatcagcagccctgcagtctgaagtattttgactagtttattactgtcagtcagttataatagctggcccgngacgttcggccgtaacggggaccgagggtacggaaacttccgaaaacgtacgtggtacggctcggacaccattccgtgtaccttcg

SEQ ID NO: 390144 - DNA, 551 bp, Homo sapiens
  misc_feature: GZ8MTXP02IFAI2.10.2.A02.1.454.CMB.2.raw
  modified_base (294)..(294): a, c, t, g, unknown or other
  modified_base (353)..(353): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccacctctcctgcagggccagtcagagtgttggcagcaggttagcctggtaccagcagaaacgtggccaggctcccgaggctcctcgtatagtggtncatccacgagggccagtggtatctcaggctaggttcccgtgcaggtggggctggggacnggtagttcacttgtacacgatcagcagcctgacagtctgtaagtattttgacttagtttacttacgttgtactagactagtataagtagtctggcccgtcgtacgttcggaccgaaggggaccgagggtacggtaaacttacgaaaacgtacgttagtacgggaacctacgacaccgtaatccgttacgtcctttacg

SEQ ID NO: 390145 - DNA, 539 bp, Homo sapiens
  misc_feature: GZ8MTXP02HCX2V.10.2.A02.1.454.CMB.2.raw
  modified_base (332)..(332): a, c, t, g, unknown or other
  modified_base (352)..(352): a, c, t, g, unknown or other
  modified_base (355)..(355): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaacgtggccaggctcccaggctcctcgtatatggtgcatccaccagggccactggtatctcaggcaggttccccgnggcagtggggtctggggacnggngttcactgtcacatcagcagcctgcagtctgaagtatttgactagtttatactgtcagcagtataatagctcggcccgtcgtaccgttcggaccgtaaacggggacccgagggtacggaaacgttaccgaaaacgtaacgtggtagggcttacggacctaccgaccgttcgtacctttactccg

SEQ ID NO: 390146 - DNA, 528 bp, Homo sapiens
  misc_feature: GZ8MTXP02GYDTD.10.2.A02.1.454.CMB.2.raw
  modified_base (293)..(293): a, c, t, g, unknown or other
  modified_base (333)..(333): a, c, t, g, unknown or other
  modified_base (354)..(354): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccacctctcctgcagggccagtcagagtgttggcagcaggttagcctggtaccagcagaaacgtggccaggctccaggctcctcgtatatgggtncatcccacgagggccatggtatctcaggcaggttccccgnggcaggtggggtctggggacnggtattcacgtgtcacatcagcagcctgcagtctgaagtatttgctagtttattactgtcagtcaagtataataggctggcccgcgtacggttccggacgaaacggggaccgagggtacgaaacgttacgaaacggtaacgtggtacggctaggcctacatccgtagtctttac

SEQ ID NO: 390147 - DNA, 595 bp, Homo sapiens
  misc_feature: GZ8MTXP02IFUEM.10.2.A02.1.454.CMB.2.raw
  modified_base (198)..(198): a, c, t, g, unknown or other
  modified_base (297)..(297): a, c, t, g, unknown or other
  modified_base (352)..(352): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccacctctcctgcagggccagtcagagtgtggcagcaggttgcctggtaccagcagaacgtgccaggcctcccgaggcctcctcggtatagtgggtcnctactcccacgacgggcccagtggtactcgtacgagggtcgtacgggttccccgngggcgtagggttggggtctaggggactagggtacgtttcacgttcgtaccacgatcagcacgctgctagttctaggtaattgtttgacttagtttactacgttgtctagtacgtaagttaataagtaggtcgtcgggcccgtacggtaccggtacgggaccgtaaacggggaccggtagggtacgtaaacgtaacgtaaacgaacgttggtacggcgtacgaccacgtatcgttactacttac

SEQ ID NO: 390148 - DNA, 556 bp, Homo sapiens
  misc_feature: GZ8MTXP02GMAGC.10.2.A02.1.454.CMB.2.raw
  modified_base (336)..(336): a, c, t, g, unknown or other
  modified_base (356)..(356): a, c, t, g, unknown or other
  modified_base (358)..(358): a, c, t, g, unknown or other
  modified_base (389)..(389): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagcccaccctctcctgcagggccagtcagagtgttggcagcaggttagcctggtaccagcagaacgtgccaggctcccgaggctcctcgtatagtggtgcatcccacgagggccatggtatctcaggcaggttccccgnggcaggtgggtctggggacngngttcactgtccacatcagcagcctgcagtcngaagtatttgactagtttattactgtcagctaagtataatagctcggcccgtcgtaccggttcggaccgtaaacggggacccggtaaggtacggtaaacgttaacgaaaacgtaacgtggtaggaacgtacggaccgtaaccctagttccgtacgtttctttacccg

SEQ ID NO: 390149 - DNA, 511 bp, Homo sapiens
  misc_feature: GZ8MTXP02F57F8.10.2.A02.1.454.CMB.2.raw
  modified_base (355)..(355): a, c, t, g, unknown or other
  modified_base (370)..(370): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccgagggccacgtggtatctcaggcctaggttccccgtggcagtggtctgggacngagttcactgtcacntcagcagcctgcagtctagaagtattttgactagtttattactgtacagtctagtaataatagtcgtaggccgcgacggttcgaccgaacgggccgaggtacgaattacaaacgaactgtgcgtgacaccatctgtcttac

SEQ ID NO: 390150 - DNA, 657 bp, Homo sapiens
  misc_feature: GZ8MTXP02J3YEH.10.2.A02.1.454.CMB.2.raw
  modified_base (225)..(225): a, c, t, g, unknown or other
  modified_base (231)..(232): a, c, t, g, unknown or other
  modified_base (234)..(234): a, c, t, g, unknown or other
  modified_base (250)..(250): a, c, t, g, unknown or other
  modified_base (257)..(257): a, c, t, g, unknown or other
  modified_base (265)..(265): a, c, t, g, unknown or other
  modified_base (285)..(285): a, c, t, g, unknown or other
  modified_base (335)..(335): a, c, t, g, unknown or other
  modified_base (387)..(387): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcgagngtgtgnngngtagtcgcgtgacagnagaacgngcgagccnccgagctcctgtatgtggtncactcccgacgacggccagtggtactcgacgacggcgtacggtcccgtgngtaggtcggtcgagggactggtagttcacgttgaccactactcgacgtaccncgtccgtacgacgtagttacgtaagttaagtttcgtttacggtacttttaagtttacgttacgtacgtacgtacgtaagttaagttaaactaacgtccggtacccggtacccgggtacccggtaccggttacccggggtaacccgggaacgggtaaaccggggtaccggtaagggttaaaccgtaaacgttaaaccggaaacggtacggttacgggtaccggtaaccgtaccgaccgtaccgttacgtttccgtttaccgttacctaccg

SEQ ID NO: 390151 - DNA, 563 bp, Homo sapiens
  misc_feature: GZ8MTXP02F4CVQ.10.2.A02.1.454.CMB.2.raw
  modified_base (340)..(340): a, c, t, g, unknown or other
  modified_base (361)..(361): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacagccaccctctcctgcagggccagtcagagtgttggcagcaggttagcctggtaccagcagaacgtggccaggcctcccgaggcctcctcgtatatggtgcatcccaccgagggccagtggtatcctcgaggcaggttccccgnggcaggtggggtctggggacnggtgttcacgtgtacacatcagcagcctgcagtctagaagtatttgactagtttattactgtcagctagttaataagtagtcgtggcccgtcggtaccggttccggaccgtaaacgggggacccggtagggtacggtaaacttaccgaaaacggtaacgtggtacggcttacggacctaccctagttctacggtctttaccg

SEQ ID NO: 390152 - DNA, 523 bp, Homo sapiens
  misc_feature: GZ8MTXP02IQFJ9.10.2.A02.1.454.CMB.2.raw
  modified_base (359)..(359): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggcctcctcgtatatggtgcatcccacagggccacgtggtactctcaggctaggttccccgtggctaggtcgggtctggggacnggtagttcactgtccacatcagcagcctgctagtctgaagtatttgctagttttatactgtcagcagtatatagctggcccgtgtacgttcggaccgtaaggggccgtagggtcgaaacttcgaaaacgtacgttgcggtctgacaccgtatctagtctttacg

SEQ ID NO: 390153 - DNA, 710 bp, Homo sapiens
  misc_feature: GZ8MTXP02JB9UC.10.2.A02.1.454.CMB.2.raw
  modified_base (225)..(225): a, c, t, g, unknown or other
  modified_base (666)..(666): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcgagngtgtgcagcgtagtacgcgtagtacagacgaagaacggtcgacgacggccctaccgacggtcctccgtacgtatagtggtcgactactacccgacgacgggacctacgtggtactcgtacgacggtcgttacggttcccggaggcgtaggtcgggtggtacggacgtaggtacgttactacgtcgtacccaacgtacgtacgacgaccgtaccgtcccgtagacgttaacggttcgtaaagggttaacttttgtttcgaaagttttaacgtttttaaactcgttagtacgtacgagttaaagttaaactaaacggtcggtacggttcccgggaaacccggttcggttaaccggggtaccggaaaccggggtaaaacgggggtaccgtaagggggtaacgttaaacttaaaccgggaaaacgttccgttggggaacccggtntacccggtaaccctaacgttcgtttaccgttactttaccgtacg

SEQ ID NO: 390154 - DNA, 621 bp, Homo sapiens
  misc_feature: GZ8MTXP02IR7EX.10.2.A02.1.454.CMB.2.raw
  modified_base (225)..(225): a, c, t, g, unknown or other
  modified_base (232)..(232): a, c, t, g, unknown or other
  modified_base (249)..(249): a, c, t, g, unknown or other
  modified_base (264)..(264): a, c, t, g, unknown or other
  modified_base (340)..(340): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccacctctcctgcagggccagtcgagngtgtgcngcgtagtcgcgtgtacngacaagacgtgacgngcctccgagtctcctgtatgtggtgcactcccacggacggcctacgtgtactcgtcgacggcgtacggttcccggnggcgtaggggtcgggtcggtacgggacgtagggttacgttaccacgttcgtacccgaactactcgaacgcaccgtcctgacgttacgtcgtaaggtaattttgttacgacgtttagtttttaactcgttgaacgtagtacgttaaggtaaataacggtcgtccggtaccgggacccgtacggttaaccgggtccggaaacggtaacggggtacggtagggtactaaaccgtaacgaaccgtagtggtacgcgtacgaccaacgttgtacgttcgttactcc

SEQ ID NO: 390155 - DNA, 417 bp, Homo sapiens
  misc_feature: GZ8MTXP02JVKQP.10.2.A02.1.454.CMB.2.raw
  modified_base (288)..(288): a, c, t, g, unknown or other
  modified_base (347)..(347): a, c, t, g, unknown or other
  modified_base (407)..(407): a, c, t, g, unknown or other
  modified_base (413)..(417): a, c, t, g, unknown or other
tcagcatagtagtgcacgaccggtgctcgatttagactcatctacaggggagagtgttagagggagaagtgccccacctgctcctcagttccagcctgaccccctcccatcctttggcctctgaccctttttccacaggggacctacccctattgcggtcctccagctcatctttcacctcaccccctcctcctccttgctttaatatgctaatgttggaggagggggtgaggtgaaagatgagctggaggaactgctcacttaggacccagacggaaccatggaacnccccagcgcagcttctcttcctcctgctactctggcctcccaggactgtggctgcaccntctgtccttcatccttccccgcatctgaccactactatgctggagcgggctggcaaggcncatagnnnnn

SEQ ID NO: 390156 - DNA, 546 bp, Homo sapiens
  misc_feature: GZ8MTXP02JOVDG.10.2.A02.1.454.CMB.2.raw
  modified_base (356)..(356): a, c, t, g, unknown or other
  modified_base (401)..(401): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggctcctcgtatatggtgcatccaccgagggccacgtggtatctcaggcaggttccccgtggcaggtggggtctggggacnggtagttcacgttgtcaccgatcagcagcctgcagtctagaagtntttgctagtttatactgtcagctagtatagtagcgtcggcccgcgtaccgttcggaccgtaaacggggaccgagggtacggtaaacgttaccgaaaacggtaaccgtggtacggtcgtcgaccgtacctactcgttcgtctttac

SEQ ID NO: 390157 - DNA, 518 bp, Homo sapiens
  misc_feature: GZ8MTXP02ID6N1.10.2.A02.1.454.CMB.2.raw
  modified_base (333)..(333): a, c, t, g, unknown or other
  modified_base (352)..(352): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccacctctcctgcagggccagtcagagtgttggcagcaggttagcctggtaccagcagaaacgtggccaggctcccaggctcctcgtatatggtgcatcccacagggccacgtggtatctcaggcaggttccccgnggcagtgggtctggggacnggagttcacgtgtccacatcagcagcctgcagtctgaagtattttgctagtttattactgtctagcagtataagtagctcggcccgtcgacgttcggccgtaacgggaccggagggtacggaacgttacaacgaacgtgtggcgtcgacaccgatctcgtcttccg

SEQ ID NO: 390158 - DNA, 693 bp, Homo sapiens
  misc_feature: GZ8MTXP02HJ92S.10.2.A02.1.454.CMB.2.raw
  modified_base (507)..(507): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagccgtggtaccagcagaacgtggccaggcctcccgaggcctccgtcgtatagtggtcgcactcccgaccgaggggcccacgttgggtactcgtcgacgggtcctacgggttcccccggtgggcgtagggttcgggggttacgtagggggaacctagggggttacgtttccgaaaccgttcggtacccgaaccctacgttaccgaacgggcccaaaccggtccccgttggcccgtaacggtttccgttaagggtaaaacggtttntttttacgggacctttaaaggtttttactttaaccgtttgggttacctaaggtacttaaagttaacttaaagtcgtacgtcgggccccggtacggtacggttccggaacggtaaggggccggtagggtagaaacgttacgaaacgtacgtcggaggcctcggacacctagttccgtcgttactacc

SEQ ID NO: 390159 - DNA, 594 bp, Homo sapiens
  misc_feature: GZ8MTXP02IZKD9.10.2.A02.1.454.CMB.2.raw
  modified_base (294)..(294): a, c, t, g, unknown or other
  modified_base (363)..(363): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaacgtggccaggctccaggctcctcgtatatgggtncatcccacgagggccacgtggtactctcgaggctaggttccccggtggccaggtcggggtctggggacngggtgttcactgtccacgatcagcagcctgcagtctgaagtatttgctagtttattactgtctagctagttaataagtagtcgtcgggacccgtacggtaccggttaccggaacccggtaaacgggggaccggtaaggggtacgggtaaaactttacggaaaaccgtaaccgtggggttacggccgttacggacctaaacccgttacgttaccgttacgtttacctttacg

SEQ ID NO: 390160 - DNA, 561 bp, Homo sapiens
  misc_feature: GZ8MTXP02IDJNV.10.2.A02.1.454.CMB.2.raw
  modified_base (359)..(359): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggggaaacagccaccctctcctgcagggccagtcagagtgttggcagcaggttagcctggtaccagcagaaacgtggccaggctcccgaggctcctcgtatagtggtgcatcccacgagggccagtggtatctcgaggcaggttccccgtggcaggtgggtctggggacnggtagttcacgtgtcaccatcagcagcctgcagtctagaagtatttgactagtttattacttgtactagctaagtataagtagctcgggcccgtcggtacgttccgggaccgtaaacggggaccgtaggggtacgtaaacttacgaaaacggtaacgtggtacggcgtacggacctacccgatttccgtacgttcctttacg

SEQ ID NO: 390161 - DNA, 575 bp, Homo sapiens
  misc_feature: GZ8MTXP02HME4Z.10.2.A02.1.454.CMB.2.raw
  modified_base (369)..(369): a, c, t, g, unknown or other
  modified_base (421)..(421): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaaacgtggccaggctcccaggcctcctcgtatatggtgcactccaccgagggcccacgttggtatccgtacaggtcgaggttccccgtggctagggtcggggttctggggacngggtacgtttcacgttgtccaaccatccagcacgcctgctagtctagaagtntttgctagtttattacgtgtcagtctaagttataagtgtacgtcggcccgcggtacggttccggaccggtaacggggaccgtagggtacggaaacttacgaaaacgtacgttcggtaggtcgtaggaccaccgtatccgttcgtttctttaccg

SEQ ID NO: 390162 - DNA, 629 bp, Homo sapiens
  misc_feature: GZ8MTXP02H4LJ6.10.2.A02.1.454.CMB.2.raw
  modified_base (304)..(304): a, c, t, g, unknown or other
  modified_base (350)..(350): a, c, t, g, unknown or other
  modified_base (374)..(374): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccagccaccctgtctgtgtctccgaggggaaacagccaccctctcctgcgagggccagtcagagtgttggcagcaggttagccctggtaccagacgaagaaacggtggccaggcctcccgaggcctcctgtatagtgggtncactccgacgagggcctagtggtactcgcgaggctacggttcccgnggcgtagggtgggtcgtggggacnggtacgttcacgttcgtaccaccgatacgacgacacggccctgaccgtagttcgtaaggtaagtttattttcgggacttaaggttttaatttacgttagtacgtaagtactaaggttaaactaaagtacggtcgttaccggggcccgtaccgggtacggttacccggggaaaccggtaaggggaccggtaagggtacgtaaacttacgaaaacggttacgtggtagcgtacgacctactagtcgtagttacctcg

SEQ ID NO: 390163 - DNA, 440 bp, Homo sapiens
  misc_feature: GZ8MTXP02I9QZQ.10.2.A02.1.454.CMB.2.raw
  modified_base (430)..(440): a, c, t, g, unknown or other
tcagcatagtagtgcacgaccggtgctcgatttagactcatctacaggggagagtgttagagggagaagtgcccccacctgctcctcagttccagcctgacccccctcccatcctttggcctctgaccctttttccacaggggacctacccctattgcggtcctccagctcatctttcacctcaccccctctcctccttggctttaatatgctaatgttggaggagggggtgaggtgaaagatgagctggaggaactgctcacttaggacccagacggaaccataggaacgccccagcgcagtcttctcttcctcctgcctactctggcctacccaggactgtcggctgccaccatctcgtccttcacttcccttcccgcacgttctgactctactatgctggacgcgggctgggacaagggcacagtgnnnnnnnnnnn

SEQ ID NO: 390164 - DNA, 615 bp, Homo sapiens
  misc_feature: GZ8MTXP02IOHQA.10.2.A02.1.454.CMB.2.raw
  modified_base (286)..(286): a, c, t, g, unknown or other
  modified_base (291)..(291): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcaggccagtcagagtgttggcagcaggttagcctggtaccagcagaaacgtggccaggctccaggctcctgtatntggtncatcccacgagggccagtggtatcgtcgaggctacggttccccgtggccgtaggttcggggtcgtggggacagggtacgtttcgacttcgtacccaccgtatccgaagccaacgcccgtagccagttcctaggtaacgttagtttttcgacttaagttttacttaccgttgtacgtagtctaagttaactaagtacgtcgtcgggccccgtacggtaccggttaccgggaccgtaacgggggacccggtagggtacggtaaacttacgaaaacgtacgttggtcggaacgtacggacctacgtattccgttcggttacttaccg

SEQ ID NO: 390165 - DNA, 680 bp, Homo sapiens
  misc_feature: GZ8MTXP02H14NS.10.2.A02.1.454.CMB.2.raw
  modified_base (367)..(367): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctcaggggaacagccacctctctgcaggccagtcagagtgtggcagcaggttagcctggtaccagcagaaacgtgccaggcctccgaggctcctcgtatagtggtgcactccgaccgagggcctagtggtatcgtcgaggtctacggttccccgtgggcctagggtcggggttcgtggggaacngggtactttcgaccgttgtaccaccagtacaggcacggcctgactagttactaggtaagttacttttcgactttaaggttttaacttaccgttggttaccgtaaggtacttaaggtttaaataaacgttacggtaccgttccggggaccccggtacgggttaccgggttaccgggaacccgtaaacgggggacccggttaaggggtacggtaaaacgtttaaaccggaaaaccggttaacgttcgggtacgggtaaccgttcggaaacccctaccgttaaacgtttccgtttaacggtttccgttttaacccg

SEQ ID NO: 390166 - DNA, 636 bp, Homo sapiens
  misc_feature: GZ8MTXP02IUPTL.10.2.A02.1.454.CMB.2.raw
  modified_base (280)..(280): a, c, t, g, unknown or other
  modified_base (291)..(291): a, c, t, g, unknown or other
  modified_base (301)..(301): a, c, t, g, unknown or other
  modified_base (339)..(339): a, c, t, g, unknown or other
  modified_base (361)..(361): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccacctctcctgcagggccagtcagagtgttggcagcaggttagcctggtaccagcagaacgtgccaggcctccgagctccncgtatatggtncatcccacgngggccagtggtatccgtacgaggctacgggttccccgnggctaggttgggtctggggacnggtacgtttcacgttcgtccaaccgtatccgagtccgaacggtcccttcgggactaacggttacctaagggtaaaagtttcgtttttacggacgtttaaagtttttacttaaccgtttgtacgtaagtcgtaaagggtttaataaacgttacggccgttacgggcccgtacgtaaccggtttcggaaccgaacgggggtaccgaggggtacggtaaacttaccgaaaacggtaactggtaacggcgtacgtaccgaacgtatcgtcgtttcctac

SEQ ID NO: 390167 - DNA, 655 bp, Homo sapiens
  misc_feature: GZ8MTXP02GQ5WX.10.2.A02.1.454.CMB.2.raw
  modified_base (304)..(304): a, c, t, g, unknown or other
  modified_base (621)..(621): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacacgccaccctctcctgcagggccagtcagagtgttggcagcaggttagcctggtaccagcaaggaaacgtggaccaggcctccgaggcctccgtcgtatagtggtcncactacccaccgagggtccctacgtggtaactccgtacgaggctacgggttccccgtagggcgtagggtcggggtcgtacggggacgtagggtacgtttccgaacgttcgtacccaaccgacttccgacgaccacggtcccgtgggacctagtcgttaggtaaagttcgtttttaggaccttaagttttacgtttactggtactagtaccttaaggttaataaagttcgcggttacggcccgtacggtaccggttacggacccggtaaaagggggacccgtagggtaggtaaacttaaccgaaaacgtacgtcgggnggtaacctggacctacgtacgtcttcgttcttac

SEQ ID NO: 390168 - DNA, 627 bp, Homo sapiens
  misc_feature: GZ8MTXP02JM8XE.10.2.A02.1.454.CMB.2.raw
  modified_base (365)..(365): a, c, t, g, unknown or other
  modified_base (447)..(447): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacagccaccctctcctgcagggccagtcagagtgttggcagcaggttagcctggaccagcaagaacgtggaccaggcctcccgaggcctccgtacgtatagtggtcgcacgtcccaaccgagggaccctacgtcggtactccgtacgacgggtcgtacgggtttccccggnggaccgtagggttcggggtctaggggactaggtacgttcacgtcgtacacgtatcagcacgtcgtgactagtctagaagttntttgacttagtttatacgtagtacacgtactaattaagtaactcggtaccgtcgggacccgtacggtaaccgggttccgaacggtaacggggtacggaaggggttacgtaaacgttacgaaaacgtacggttggtacggtaacgtacgacccgtacgtacgttcttacggtactttaccg

SEQ ID NO: 390169 - DNA, 755 bp, Homo sapiens
  misc_feature: GZ8MTXP02JQA2D.10.2.A02.1.454.CMB.2.raw
  modified_base (197)..(197): a, c, t, g, unknown or other
  modified_base (310)..(310): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacngccaccctctcctgcagggccagtcagagtgttggcagcgtaggttacgccgtggtaccagcgaaggaaacgtggaccaggcctacccgaggccttccgtcgtaatagtggtncactcccgacgacgggccaacgttggtaactccgtgacggcgtacgggttccccgtggacgtagggttggggtcctagggggaccaggggtacgtttaccgacgttacggtacccgaacctaacgttccgaaacgtcccgaacgggtacccccttggggaccctaaagggtttccgtaaggggtaaaacggttttgtttttacggaccgtttaaaggttttttaaccttaaaccggtttggtttaaccgaccgggttaacttaaagggtttaaacttaaaggttaaccggccggtttaccggggacccccggttacgggtaccggtttacccggggaccgtaaaacgggggtacccgggtagggtacggtaaaacgttaacgaaaaccgtacggttcgtagggaaccttcggaacctaccgtagttccgttacgtacctttaccg

SEQ ID NO: 390170 - DNA, 585 bp, Homo sapiens
  misc_feature: GZ8MTXP02HQU2T.10.2.A02.1.454.CMB.2.raw
  modified_base (262)..(262): a, c, t, g, unknown or other
  modified_base (345)..(345): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgtgcagcaggttagcctggtaccagcaggaacgnggccagggtcccaggctcctgtatagtggtgcatcccgaccgagggcccaacgttggtactcgtacgaggcctagggttccgnggctaggttgggtctggggaccagggtcgtttacacttggtacccaaccgtagtcacgcacgccgtagcgtagtctaggtaagtagttttgacttagtttattacgttgtacagtactaagttataagtagcgtacggccgtacggtacgttcgggaccgaaggaccggaggtagtaacgttacgaaaacgtacgtggagtactaacgacaaccgtataccgttcgtacctttactaccg

SEQ ID NO: 390171 - DNA, 613 bp, Homo sapiens
  misc_feature: GZ8MTXP02IMTB9.10.2.A02.1.454.CMB.2.raw
  modified_base (245)..(245): a, c, t, g, unknown or other
  modified_base (286)..(286): a, c, t, g, unknown or other
  modified_base (291)..(291): a, c, t, g, unknown or other
  modified_base (316)..(316): a, c, t, g, unknown or other
  modified_base (335)..(335): a, c, t, g, unknown or other
  modified_base (409)..(409): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagcccaccctctcctgcagggccagtcagagtgttggcaggcaggttancctggtaccagcagaacgtgccagctccaggctcctgtatntggtncactccaccagggccagtggtatcncgaggctacgggttcccgnggctaggggtgggtcgtaggggacaggtacgttcaccgttgtaccaccatcagtcacgctgctagtctagaatntttgacttagtttattacgtgtactagacttaagtaagtaaatggtccgttcgggaccccgtacggtaccggttacggggaacccgttaaagggggaacccggtaggggtaacgtaaaaccgtttaccgaaaaaccgttacggttacgggtacggtaaccgtacggacccgtaaacctagttccgtttaccggttactttcccg

SEQ ID NO: 390172 - DNA, 599 bp, Homo sapiens
  misc_feature: GZ8MTXP02HPYJE.10.2.A02.1.454.CMB.2.raw
  modified_base (296)..(296): a, c, t, g, unknown or other
  modified_base (340)..(340): a, c, t, g, unknown or other
  modified_base (362)..(362): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggcctcccaggcctcctcgtatatggtncatccacgagggccacgtggtatctacgaggctaggttccccgnggctaggtggggtctggggacnggtagtttcacttcgtacgaccatccagtcacgtccctggcctacgtctaggtaagtatttttgacttagttttacttctgttactagactaggttaataagtcgacgtacggtcccgagttaccggttcggacccggtaacggggtaccgggtagggtacggtaaacgttaccgaaaaccggtacttgggtacggtccgtaggcccgtacccagtttccgtacgtttccttaaccg

SEQ ID NO: 390173 - DNA, 727 bp, Homo sapiens
  misc_feature: GZ8MTXP02GTJKF.10.2.A02.1.454.CMB.2.raw
  modified_base (256)..(256): a, c, t, g, unknown or other
  modified_base (273)..(273): a, c, t, g, unknown or other
  modified_base (286)..(286): a, c, t, g, unknown or other
  modified_base (289)..(289): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgccagggccagtcagagtgttggcagcgaggttacgcctggtaccngctagaacgtgcaggcnccagctctgtatnggncatccacgagggcctacgtggtactctcgacggcgtacggttccccggtggccgtagggttcggggtcgttacggggaacctggggtacgtttcgacgttaggttacccaacccgtaattccgaacgtccggaaccgtccccgttagggccctaaggtttaccgtaacggttaaacggttaagttttttcccgggactttaagggtttttaaaacttcccgtttaggtacccgtaaggtaccttaacggggttaaacttaaaagtccggtcgttaccggggacccgtaccggggtaaccggtttccggggtaaccggaaaacgggggtcccggtaaaggggttacgggttaaaacttaccgggaaaaacggtaaccgttgggtcggggaaccttacgggaccctaaacggtacttccgtttacggttaacccctttcg

SEQ ID NO: 390174 - DNA, 616 bp, Homo sapiens
  misc_feature: GZ8MTXP02HK653.10.2.A02.1.454.CMB.2.raw
  modified_base (197)..(197): a, c, t, g, unknown or other
  modified_base (292)..(292): a, c, t, g, unknown or other
  modified_base (341)..(341): a, c, t, g, unknown or other
  modified_base (358)..(358): a, c, t, g, unknown or other
  modified_base (402)..(402): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacngccaccctctcctgcagggccagtcagagtgttggcagcaggttagcctggtaccagcagaacgtgccaggctccaggctcctcgtatagtggtncactccaccgaggggccacgtggtatctcgaggctacggtttccccggnggcgtaggtcgggtcgnggggactggtgttcacgtcgtaccacgtatcgacgcgacgccgngactagtcgtagtaagttagtttacgtactttacgtttacttacgttgtacgtagtacgtaagtaagtaagtacgtcgtacgggtaccccggacggtaccggttaccgggaccggtaacggggaccggtagggttaaacggtaaacgttaacggaaaaccgtacggtacggtacggtccgtacgaccgtaccgtacgttccgtacgttacctcg

SEQ ID NO: 390175 - DNA, 467 bp, Homo sapiens
  misc_feature: GZ8MTXP02G2YLM.10.2.A02.1.454.CMB.2.raw
  modified_base (204)..(204): a, c, t, g, unknown or other
  modified_base (244)..(244): a, c, t, g, unknown or other
  modified_base (251)..(251): a, c, t, g, unknown or other
  modified_base (257)..(257): a, c, t, g, unknown or other
  modified_base (263)..(263): a, c, t, g, unknown or other
  modified_base (265)..(265): a, c, t, g, unknown or other
  modified_base (268)..(269): a, c, t, g, unknown or other
  modified_base (271)..(272): a, c, t, g, unknown or other
  modified_base (279)..(279): a, c, t, g, unknown or other
  modified_base (290)..(290): a, c, t, g, unknown or other
  modified_base (301)..(301): a, c, t, g, unknown or other
  modified_base (312)..(312): a, c, t, g, unknown or other
  modified_base (318)..(318): a, c, t, g, unknown or other
  modified_base (333)..(333): a, c, t, g, unknown or other
  modified_base (350)..(350): a, c, t, g, unknown or other
  modified_base (360)..(360): a, c, t, g, unknown or other
  modified_base (371)..(371): a, c, t, g, unknown or other
  modified_base (374)..(374): a, c, t, g, unknown or other
  modified_base (385)..(385): a, c, t, g, unknown or other
tcagcatagtagtgcacgaccggtgctcgatttagactcatctacgagggggaggaactgctcacttaggacccagacggaaccatggaagccccagcgcagcttctcttcctcctgctactctggctccagataccactggagaagtagtgatgacgcagtctccagccacctgtctgtgtctccgagggaaacagccacctntcctgccagggcagtcagagtgtgcagcaggtgctggacngcagaangcagcnccagcncnganngnnatccacnggcactgatcnagcaggtcccnggcagtggtcngggacngacgttcattgcacntcagctagccagcagtntgagattgtntagttatactntanagatatataanagcgtcgcgacgacgtcgacgacggacgaggtagaacgtaacgaacgaacgtagagaacgtacgacacactacgtcgtactc

SEQ ID NO: 390176 - DNA, 622 bp, Homo sapiens
  misc_feature: GZ8MTXP02FHBRT.10.2.A02.1.454.CMB.2.raw
  modified_base (197)..(197): a, c, t, g, unknown or other
  modified_base (299)..(299): a, c, t, g, unknown or other
  modified_base (350)..(350): a, c, t, g, unknown or other
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacncgccaccctctcctgcagggccagtcagagtgttggcagcaggttagcctggtaccagcaggaaacgtggccaggcctcccgaggcctcctgtatagtggtncatcccaccgagggtcccaagtggtatcctcgaggtctacgggttccccgnggccgaggtcggggtactaggggactaggacgttcagttcgtaccacgtaatcgaacgctacgcctaggcctagttctaggtaagttattttacggactttagttttaacgttaccgtgtacagtactaaaggttaataaagtcgtcgttaccgggcccgtacggtaccgggtttcggaaccggtaaacggggaccggtaggtaacggaaacttacgaaaacggtacgtcggtagggaactcggacctaacgtcttacgtcgtactttaccg

SEQ ID NO: 390177 - DNA, 428 bp, Homo sapiens
  misc_feature: GZ8MTXP01CC4CQ.13.61.F06.1.454.CMB.2.raw
  modified_base (423)..(428): a, c, t, g, unknown or other
tcagtcacgtactacacgaccggtgctcgatttagctacgctctaagggaagggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctgggggccaagggtcgatggtcatcgctcttcagcctccaccaagggcccatcggtcttccccctggcgcccctgctccaggagcacctccgagagcaccagcggccctggggctgcctgggtcaaagggctacttcctagtacgtgactgagcgggctggcaaggcgcatagnnnnnn

SEQ ID NO: 390178 - DNA, 525 bp, Homo sapiens
  misc_feature: GZ8MTXP01CCWF9.13.61.F06.1.454.CMB.2.raw
  modified_base (346)..(346): a, c, t, g, unknown or other
  modified_base (370)..(370): a, c, t, g, unknown or other
  modified_base (509)..(525): a, c, t, g, unknown or other
tcagtcacgtactacacgaccggtgctcgatttagctacgctctaagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagacggcgtactacgttgtcggctggggcgtactttgacagtttggggccaaggggcacgtggtcaccgtctccccaagcttccaccaacgggcccatccggtccttcccccgnggccgccctcgcctccgacggacncaccctcccgagaacgccaacgagcccgggccctgggggcctcggcccgtgggtaccaaacgggaccttaccttcccgtaggttacgttcggaacttgggaggtccgggcgtgggaccgaaacggggcggcgagttagnnnnnnnnnnnnnnnnn

SEQ ID NO: 390179 - DNA, 490 bp, Homo sapiens
  misc_feature: GZ8MTXP02JFJGX.13.61.F06.1.454.CMB.2.raw
  modified_base (470)..(490): a, c, t, g, unknown or other
tcagtcacgtactacacgaccggtgctcgatttagctacgctctaagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgactagtttggggccaagggacactggtcaccgtctccccaagccttccaccagggcccatcggtccttccccctggccgccctgcctccacggagccacctccgagacgcacgagccggccctgggctcgccgtggtacaaggactaccgttcctagtaccgtgacctgacggcgggctcgggacgaaagggcggacctagagnnnnnnnnnnnnnnnnnnnnn

SEQ ID NO: 390180 - DNA, 476 bp, Homo sapiens
  misc_feature: GZ8MTXP02GN8CJ.13.61.F06.1.454.CMB.2.raw
  modified_base (178)..(178): a, c, t, g, unknown or other
  modified_base (357)..(357): a, c, t, g, unknown or other
  modified_base (362)..(362): a, c, t, g, unknown or other
  modified_base (377)..(377): a, c, t, g, unknown or other
  modified_base (387)..(387): a, c, t, g, unknown or other
  modified_base (396)..(396): a, c, t, g, unknown or other
  modified_base (409)..(409): a, c, t, g, unknown or other
  modified_base (434)..(434): a, c, t, g, unknown or other
  modified_base (438)..(438): a, c, t, g, unknown or other
  modified_base (448)..(448): a, c, t, g, unknown or other
  modified_base (462)..(476): a, c, t, g, unknown or other
tcagtcacgtactacacgaccggtgctcgatttagctacgctctaagggaaaggggctggagtgggtggccaacataaaggaggatgggagtcagacatattatgtggagtctgtgcggggccgattcaccatttccagagacaacgccagatcgtcagtatatctgcaaatgaggancctgagagtcgatgatacggctacatattattgtgcgagaattgactagttttccagacggcgtacttacggttggtcggcggtggggcgtagttgactaggttcggggaccgaaggtacagtcggtccaccgtctcccaagtcctaccgaccgacggccctagtccggtccctccccnggccncctgcctcgacggcnccacgtcggnggggcacgnggccgccgtggcncgcgtgacacgctactctcgtacgnacgngacggcgcgnggacgagcgcagcnnnnnnnnnnnnnnn

SEQ ID NO: 390181 - DNA, 523 bp, Homo sapiens
  misc_feature: GZ8MTXP01DAUL6.11.76.G10.1.454.CMB.2.raw
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagaatctttagactattccactaagagagtattgttagttggtaccaaacagaagccaggccagcctaccaaagcagctcatttattgggcatctactcgggatttcccccgggggtccctgacccgtattcccggtgggctaaggtgggatcgtaggggaactaaagtttcaactctcaccatcaatagcctgcaggctagaagatgtggggcagtcttattattgtcagacaatattatacttctcttcgatcacgtttggcttaggggccagggctaggaagatcagtaacgaacgtgg

SEQ ID NO: 390182 - DNA, 490 bp, Homo sapiens
  misc_feature: GZ8MTXP01BNBEK.11.76.G10.1.454.CMB.2.raw
  modified_base (330)..(330): a, c, t, g, unknown or other
  modified_base (463)..(463): a, c, t, g, unknown or other
tcagcgagagataccacgaccggtgctcgatttagtcactcatacaggcatacagggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccataagagagatttgttagttggtaccaacagaagccaggccagcctccaaagcagctcatttatgggcatctactcgggattccgggggtccctgaccgattccccgnggcagtggatctgggaacaaatttcactctcaccatcatagcctgcaggctagaagatgtgcagcttattagttgtcagcaatattatacttctcttccgattcacttttggccaggggaccaggctgggagnttcgaagacgaactggtggctgcaacc

SEQ ID NO: 390183 - DNA, 518 bp, Homo sapiens
  misc_feature: GZ8MTXP01AYTTA.11.76.G10.1.454.CMB.2.raw
  modified_base (501)..(501): a, c, t, g, unknown or other
tcagcgagagataccacgaccggtgctcgatttagtcactcatacaggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatctttagactattccactaagagagtattgttagttggtaccaacagaagccaggccagcctaccaaagcagctctatttattggcatctacgtcgggacttcccccggggtccctggacccgtattcccgtaggcaagtggatcgtgggactaaatttcactctcaccatcaatagcctgctaggctagaagatgtggggcagtcttattattgtctagactaatattatacttctcttccgatcttacgtttggccttagggggccaggctggaanatcgagaacgaacgtgg

SEQ ID NO: 390184 - DNA, 604 bp, Homo sapiens
  misc_feature: GZ8MTXP01BGS9N.11.76.G10.1.454.CMB.2.raw
  modified_base (408)..(408): a, c, t, g, unknown or other
  modified_base (412)..(412): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgaccaagtctccagattccctggctgtgtctcgtgggcgagaccggccaccatcaactgcaagtccagtcagtaattctttagacttattccaataagagagtatttgtagttgtacaacagagcagccagcctacaagcagctctatttagtggacatctacgtcggtacgttccggggtccctgaccgtacttcccggtggcaggtgtatcgtagggtaactaaactttcacctctaccactatacaatcgcctgcgaggctaggaagtntggnggctagtctttaattgttgtcaagactaaatttatttaacgttacctttcgttaccttacccgtatttcccgttacggttttcgggacccggttaacgggggtaacccttagggtccggttaggggaattacgttaccggaaagggtaacccgtaagttcgggtgggttaccccttaagggccccttaaccg

SEQ ID NO: 390185 - DNA, 520 bp, Homo sapiens
  misc_feature: GZ8MTXP01AKHWX.11.76.G10.1.454.CMB.2.raw
tcagcgagagataccacgaccggtgctcgatttagtcactcatacaggggagctacaacaggcaggcagggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatctttagactattccactaagagagtattgttagttggtacaacagaagcagccagcctcaaagcagctcatttatggcatctactcggacttccccggggtccctgaccgtattccgtggcaagtggatcgtgggactaaatttcactctcaccatacaatagcctgcaggctgaagatgtgggcagtcttattattgtcagactaatattatacttctcttccgattcttacgttttcggccgttacggggccagggtcgttgggaacgagtccgaaggaaccgttaaacgttggg

SEQ ID NO: 390186 - DNA, 699 bp, Homo sapiens
  misc_feature: GZ8MTXP01BAM0O.11.76.G10.1.454.CMB.2.raw
  modified_base (117)..(117): a, c, t, g, unknown or other
  modified_base (260)..(260): a, c, t, g, unknown or other
tcagcgagagataccacgaccggtgctcgatttagtcactcatacaggcatacaggggcagcaagatggtgttgcagacccaggtcttcatttctctgttgctctggatctctggtncctgcggagacatcgtgatcgacccagtctccagtacttcccgtggctgtgtctcgtgggcgagaccggccaccatcaactgacaagtccagtcagtattctttagactatccaataagagtagtatttgttagttgtacaanagaagcagccagcctacaaagcagctactatttagtggactatctacgtcgggtacgttcccggggtccctaggacccgtacgttccccggtggacgtaggtggtacttccggtaggggtaacttaaaacttttccaaccttcctaaccaaccctaattacaaacttacgccgttagacgtaacggcgttaagggaaaacgtggtaggttacgggaccgtaagttaccgttttaaatttaggtttacggttacctaaagtaccttaaaatttacttttaaacttaccttttacccttccgtttacccgtatttccctttaaccggtttttcgggaccccggttaacggggggtaccccttaaggggtccgttaagggaacgttacgttaccggaacgtaaccgtaacgttgggtacgggttccttaacggcctaacccg

SEQ ID NO: 390187 - DNA, 556 bp, Homo sapiens
  misc_feature: GZ8MTXP01CR1U0.11.76.G10.1.454.CMB.2.raw
  modified_base (254)..(254): a, c, t, g, unknown or other
  modified_base (506)..(506): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagattccctggctgtgtctctgggcgagacggccaccatcaactgacaagtccagtcagtaatctttagactattccataagagagtatttgttagttgtaccaanagaagccaggccagcctacaaagcagctctattatgggacatctacgtcgggacgttccgggggtccctggaccgtagtttcccccggtggacagtggattacgtagggaactaaatttccaactcctacaccatacaatacgctgcaggctagaaagatgtggacagtacttaattagttgtacaagctaaattattaattacttccttcttaccgtattcctacgttttggacccggttaggggtacccngggtactggaagttcttacgaagaccgtaagttggtggctgaacctaacc

SEQ ID NO: 390188 - DNA, 575 bp, Homo sapiens
  misc_feature: GZ8MTXP01AT4VV.11.76.G10.1.454.CMB.2.raw
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagaccggccaaccatcaactgacaagtccagtcaagtaattctttagacttatcactaagagagtattgttagttaggtaaccaacagaacgccaggccacgcctaccaaagcagctctatttagtggctatctacgtcggggtacgttccccggggtccctagaccgtacgttccggtagggctaaggtgactcgtagggaactaagttcactctacacatacaatcgacctgacgaggctagaagtagtcggtggggctagtctttattatgtcagtactaattattactcttctcgttaccattccgttacgtttcggaccgttacgggggaccttagggtccttaggggaatactacgaacggtaacgttaacgttggg

SEQ ID NO: 390189 - DNA, 562 bp, Homo sapiens
  misc_feature: GZ8MTXP01AWBMW.11.76.G10.1.454.CMB.2.raw
  modified_base (258)..(258): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagtaattctttagactattccaataagagtagtatttgttagttggtaccaanagaagccaggccagcctaccaaagcagctctatttagtggctatctacgtcgggtacgttcccgggggtccctggaccgtacgttccccggtggcgtaggtggattcgtagggtaactaaatttccacttcctacaaccatacaatacgcctgcgaggctagaagtagtgtggctagtactttaattagttgtacagtactaattattattacttctcttcgtatcgtcgtttggccgttagggtaccaggtcgtggaagttcttacgaacgacgtaacgtggtcggttcttcggccgtaaccg

SEQ ID NO: 390190 - DNA, 591 bp, Homo sapiens
  misc_feature: GZ8MTXP01D1Z4R.11.76.G10.1.454.CMB.2.raw
  modified_base (437)..(437): a, c, t, g, unknown or other
  modified_base (551)..(551): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgaccaagtcctccagacttccctggctgtgtctcgtgggcgagacggccaccatcaactgcaagtccagtcagtaattctttagacttattccaataagagtagtatttgttagttaggtaaccaacagaagccaggaccacgacctaccaaagcaacgctactatttagttgggactactacgttaccgtcgggtacgttcccggggttccctggacccgtacgttccccggtggacgaggtggtactcgtagggaactaaattccactctccacatacaatgcctgacaggctaagagntggcggacagtactttagttagttgtacagactaattattactttacctttccttcttacccgtattccttaacggtttcgggaccgagggggtcccagggtcgtggaacgttnttaccgaagacgtaacgttggcggttactcggaacctaac

SEQ ID NO: 390191 - DNA, 682 bp, Homo sapiens
  misc_feature: GZ8MTXP01DHQZF.11.76.G10.1.454.CMB.2.raw
tcagcgagagataccacgaccggtgctcgatttagtcactcatacaggcatacaggggcagcaagatggtgttgcagacccaggtcttcatttctctgttgctctggatctctggtgcctgcggagacatcgtgatgaccaagtctccagtacttccctggctgtgtctcgtgggcgaggaccggccaccatacaactgacaagtccagtcaagtaattctttagacttactaccaataagagtagtattttgtagttacgaacaacagaacgccgaggccaacgccctacaaagcagtctctaagtttagtggactatcgtacggtcggtacgttcccgggtcctgtaccgtactcccggtggacgtaggtaggtactacgtacgggtaacttaaactttcccgaaaccttccgtaccaacctacgtaacaaacgttccgccgtacggacgaggtacgtaagaaagtagttcggagtctaagttacttttaagttaggttacgtacaagtaccttaaaatttctttaacttcgtttaccttccgtttaccgactttacgtaccggttttaagggaccccgttaagggggtaccccgaggtacggtcggaaacgttcgttaacggtaaccgggtaacgttaaccgttggggtacgttaccctaacggttaaccccgtaaccg

SEQ ID NO: 390192 - DNA, 602 bp, Homo sapiens
  misc_feature: GZ8MTXP01DWSD9.11.76.G10.1.454.CMB.2.raw
  modified_base (485)..(485): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatcgacccagtcctccagacttcccgtggctgtgtctcgtggggcagaccggccaccatcaactgacaagtccagtcaagtaattctttaagacttatccactaagagtagtattagttagttagtaacaacgagaacgccagccagcctacaaagcagctactatttagtggctatctacgtcgggtacgttcccccggggtcctggaccgtacgttccggtaggactggtggtactcgtagggtaactaaactttcacctctacaacctatacaagtacgcctgaccgaggactagaagtagtggtggggactagtctttaagttagttcgtanacgtaataaatttattaacttcctttcttccttaccgttattaccgttacgtttacgggaccggttacggggcgttacgggcgtaggaacgtacgtacgagtaaccgttaacgtggg

SEQ ID NO: 390193 - DNA, 598 bp, Homo sapiens
  misc_feature: GZ8MTXP01ELILL.11.76.G10.1.454.CMB.2.raw
  modified_base (276)..(276): a, c, t, g, unknown or other
  modified_base (376)..(376): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatcgacccagtctccagacttcccgtggctgtgtctcgtgggtgacgaccgccaccatcaactgacaagtccagtcagtaattctttagacttatccaataagagtatattgtagttcgtaaccaanagaacgccaggaccagccctaccaaagcagctactatttagtggctattcctacggtcgggtacgtttccccccggggtcctagtacccgtagttccggngactggtagatcgtagggaacttaattcactctacactatacaactacgactgacgagggtactagaagtagtcggttaggggactaagttactttaatttagtcgtactaagtaactaaattatttaacttaccttcgttaacttaccttattccgttacgtttcggaccgttacggggccttagggtcgttagaagtactacgacgtaaccgaagttcgg

SEQ ID NO: 390194 - DNA, 504 bp, Homo sapiens
  misc_feature: GZ8MTXP01E5O8X.11.76.G10.1.454.CMB.2.raw
  modified_base (183)..(183): a, c, t, g, unknown or other
  modified_base (252)..(252): a, c, t, g, unknown or other
  modified_base (355)..(355): a, c, t, g, unknown or other
  modified_base (379)..(379): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctntgggcgagacggccaccatcaactgacaagtccagtcagaattcttttaagactattccactaagaganattgttagttggtaccaacagaagccaggccagcctacaaagcagctcatttatggcatctacgtcgggacttccccggggtccctgaccgtatcccgtggcngtgatctgggactaaattcactcncacatcaatagcctgcaggctgaagatgtggggcagtcttattactgtcagacaatattatcttcgtctcgatcttacgtttggcccttaggggccaggtctggaagatcagtaaccgaagttgg

SEQ ID NO: 390195 - DNA, 553 bp, Homo sapiens
  misc_feature: GZ8MTXP01CPF1M.11.76.G10.1.454.CMB.2.raw
  modified_base (260)..(260): a, c, t, g, unknown or other
  modified_base (356)..(356): a, c, t, g, unknown or other
  modified_base (505)..(505): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcagaattctttaagactattccaataagagagtatttgttagttggtaccaanagaacgcaggccagcctaccaaagcagctactatttagtgggcagtctacgtcgggacgttcccggggtccctggaccgtagttcccccgtgggcnggtggactcgtagggaactaaatttccacttcacactatacatagcctgcaggctagaagtgtgtggctaagtctttaagttagttcgtatagtactaattattattacttctacttcctacttctcgtttggaccgttggggtaccgnggtacgtggagttgacgtaagaccgtaagtggtaggctcgcctaaccg

SEQ ID NO: 390196 - DNA, 688 bp, Homo sapiens
  misc_feature: GZ8MTXP01ANVMJ.11.76.G10.1.454.CMB.2.raw
  modified_base (174)..(174): a, c, t, g, unknown or other
  modified_base (232)..(232): a, c, t, g, unknown or other
  modified_base (242)..(243): a, c, t, g, unknown or other
  modified_base (245)..(245): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (263)..(263): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatcgacccagtctccagacttcccnggctgtgtctcgtggcagacggccaccatcaactgacaagtccagtcagtatctttanctatcatagnntntgtntgacangancagcngctacaagcagctcatttgcggacatctacgtcgggtacttccccggggcctaggacccgtagttcccgtggcctaaggtggtacttcggagggtacctaaacgtttcaaccttctaccaacctatactaaactacggtaccttgaccgtacgggaccttacggaaagtgttaaggtcgggggtactaacggttaaccgtttaagtttaaactttcggggtaaaccaggttaacccgtaaactttaaggtttaaaccgtttaaccgtttccctttaacccggtacccgggtttaaacgttttccccttaaaccgggttttttaccggggaacccgggtttaaacgggggaccccgttaggggtaaccggtttccgggaaagtaacgttcccggaaagggtaaccgttaaaccgggtttaacgggg

SEQ ID NO: 390197 - DNA, 487 bp, Homo sapiens
  misc_feature: GZ8MTXP02FZ6I4.11.76.G10.1.454.CMB.2.raw
  modified_base (344)..(344): a, c, t, g, unknown or other
tcagcgagagataccacgaccggtgctcgatttagtcactcatacaggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactatccactaagagagattgtagttggtaccaacagaagccaggccagcctcaaagcagctcatttatggcatctactcgggattccccggggtccctgaccgattccgtggcngtggatcgtgggactaaatttcactctcaccatcaatagcctgcaggctagaagatgtggcagctttattattgtcagctaatattatacttctacttcgatctactttcgacctagggaccaggctggagatcagacgactg

SEQ ID NO: 390198 - DNA, 502 bp, Homo sapiens
  misc_feature: GZ8MTXP02FU2VT.11.76.G10.1.454.CMB.2.raw
  modified_base (477)..(477): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccataagagagatttgttagttggtaccaacagaagccaggccagcctccaaagcagctcatttatggcatctactcgggattccggggtccctgaccgattccccgtggcagtggatcgtgggacaaatttcactctcaccatcaaatagccctgcaggctagaagatgtggcagtctttaattattgtacagtacaaattacttatactttcttcttccgattctactttcggcctaggggacccaggctgganatcaagacgaactgtggctcgcaac

SEQ ID NO: 390199 - DNA, 527 bp, Homo sapiens
  misc_feature: GZ8MTXP02GMXEA.11.76.G10.1.454.CMB.2.raw
  modified_base (355)..(355): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagaccggccaccatcaactgcaagtccagtcagtaattctttagacttattccactaagagagattgttagttggtaccaacagaagccaggccagcctcaaagcagctcatttatggcatctacgtcggattccccggggtccctgaccgattcccgtggcnggtggatcgtagggactaaagtttcactctcaaccatacaatacgcctgcaggctagaagagtgtggcagtcttattatgtcagtacaatattactacttctcttcgtatctacgtttcggaccgaaggggtaccaggccgtaggagtacgtacgaaggtaccgtaagtcgg

SEQ ID NO: 390200 - DNA, 491 bp, Homo sapiens
  misc_feature: GZ8MTXP02IB2L2.11.76.G10.1.454.CMB.2.raw
  modified_base (351)..(351): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcagacggccaccatcaactgcaagtccagtcagaatctttagactattccactaagagagatttgttagtttggtaccaacagaagccaggccagcctaccaaagcagctcatttattggcatctactcgggattccccggggtccctgaccgattccgtggcnggtgatcgtgggactaaatttcactctcaccatcaatgcctgcaggctagaagatgtgcagtcttattatgtcagcaatattatacttctcttcgatctactttgccgtacgggacaggctggacatcgagacgaactgg

SEQ ID NO: 390201 - DNA, 540 bp, Homo sapiens
  misc_feature: GZ8MTXP02JGZJM.11.76.G10.1.454.CMB.2.raw
  modified_base (341)..(341): a, c, t, g, unknown or other
  modified_base (351)..(351): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgacaagtccagtcagaattctttagactatccactaagagagatttgttagttggtaccaacagaagccaggccagcctacaagcagctcatttatggcatctactcgggtattccccggggtcctgaccgtnttccgtggcngtggatcgtagggactaaatttcaacttctacacccataccaaatacgccctgcgaacggtctagaagatcggtggctagtactttattaattgtacagtactaattacttatacttcttctcgtatctacgtttcggcctaggggtacccaggtcgtacggtaacgataccgagtacgtaacgttggg

SEQ ID NO: 390202 - DNA, 540 bp, Homo sapiens
  misc_feature: GZ8MTXP02ISLD5.11.76.G10.1.454.CMB.2.raw
  modified_base (275)..(275): a, c, t, g, unknown or other
  modified_base (296)..(296): a, c, t, g, unknown or other
  modified_base (351)..(351): a, c, t, g, unknown or other
  modified_base (362)..(362): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtcctccagattccctggctgtgtctcgtgggcgagaccggccaccatcaactgacaagtccagtcagaattctttagacttattccactaagagagtatttgttagttggtaccaanagaagccagccagcctcaaancagctcatttatggcatctacgtcggtacttccccggggcctagaccgattccgnggcagtgatcngggaactaatttcactctacacatcaatgctgcaggctagaagatgtggacagtactttattatcgtcagctaaattattaatacttctaccttacccgtatcttacgtttcggaccgaacgggggaccctagggaaccgttggggaatacgtaccgaagggtaacccgtaaacgtgg

SEQ ID NO: 390203 - DNA, 636 bp, Homo sapiens
  misc_feature: GZ8MTXP02HCNS2.11.76.G10.1.454.CMB.2.raw
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagtatctttagactatcataagagatattgttagttgtaccaacagaagccaggccagcctacaaagcagctctatttagtggctatctacgtcgggtacgttcccccggggtccctggaccgtacgttccggtggccgtggtcggtagtccggtaggggtaacctaaatttccgaacttcctacctaaccctatacctaaatacgacctcgacgtacggtactagaacgtaagttgggtcggtaaaaacgtgttactttaagtttacgttaggtactaggtaactaaattaatttaacttaacctttccttaccgtttacccgttacttaccgttaccgttttacggtaccggtacggggtaacccgtaagggtccgtagggacgtacgtaccgtaggtaaccggtaacgtcgg

SEQ ID NO: 390204 - DNA, 509 bp, Homo sapiens
  misc_feature: GZ8MTXP02F3QY2.11.76.G10.1.454.CMB.2.raw
  modified_base (275)..(275): a, c, t, g, unknown or other
  modified_base (352)..(352): a, c, t, g, unknown or other
  modified_base (356)..(356): a, c, t, g, unknown or other
tcagcgagagataccacgaccggtgctcgatttagtcactcatacaaggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagacttattcccaactaagagagtatttgttagtttggtaccaanagaagccaggccagcctccaaagcagctcatttatggcatctactcgggattccccggggtccctgaccgattccgnggcngtgatcgtagggactaaagtttcactctcacccatacaatagcctgcagctagaagatgtggcagtacttattattgtcagctaatattatacttctcttccgatctactttcggaccgtagggaccaggcgtggagactcgagacgaactgg

SEQ ID NO: 390205 - DNA, 490 bp, Homo sapiens
  misc_feature: GZ8MTXP02GEKKM.11.76.G10.1.454.CMB.2.raw
  modified_base (350)..(350): a, c, t, g, unknown or other
  modified_base (358)..(358): a, c, t, g, unknown or other
  modified_base (477)..(477): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatctttagactattccaactaagagagtattgttagttggtaccaacagaagccagccagcctccaaagcagctctatttatggcatctacgtcggattccccggggtccctgacgattccgtggcngtgatcgnggacaaatttcactctcaccatcaatagcctgcagctagaagatgtgcagtcttattatgtcagcaatatatacttctcttcgatctatttcgaccgagggaccaggcgtaggagtacngacgacgaatcgg

SEQ ID NO: 390206 - DNA, 563 bp, Homo sapiens
  misc_feature: GZ8MTXP02IMFEE.11.76.G10.1.454.CMB.2.raw
  modified_base (373)..(373): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagaattctttagactattccactaagagagtatttagttagtttggtaccaacagaagccaggccagcctaccaaagcagctactatttagtgggcatctacgtcgggtacgtttcccccggggtcccctgacccgtagttcccggtggcngtggatcgtaggactaaatttcactctcaccatcaatgcctgaccaggtctagaacgtatggtaggactagtctttatattgtacagtactaaatttataacttacttccttacttaccgattcgttacgtttcgggaccgtacggggtacctaggggctagggaagtactagacggtaccgtaacgtgg

SEQ ID NO: 390207 - DNA, 560 bp, Homo sapiens
  misc_feature: GZ8MTXP02H0HTU.11.76.G10.1.454.CMB.2.raw
  modified_base (254)..(254): a, c, t, g, unknown or other
  modified_base (258)..(258): a, c, t, g, unknown or other
tcagcgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcagaattctttagacttattccataagagagtattgttagttgacanagancagcagcctacaaagcagctactatttagtggctatctacgtcgggtacgttcccggggtccctgaccgtagtttcccccgtggctaggtggattcgtagggactaaatttcacttcctacacatactaatacgcctgcgaggctagaagataggtgcagtactttattattgtacgtagactaattaatttacttaactttcttaccttcctactcttacgttttcggaccgtacggggaccgtacggtacgtaggacgtacgtacgaacgtacggaacgttcggtaggtcgtcgacgacc

SEQ ID NO: 390208 - DNA, 577 bp, Homo sapiens
  misc_feature: GZ8MTXP02GFOG5.11.76.G10.1.454.CMB.2.raw
  modified_base (260)..(260): a, c, t, g, unknown or other
  modified_base (347)..(347): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccacatcaactgcaagtccagtcagatctttagactatcatagagagattgttagttgtaccaanagaagccagccagcctccaaagcagctctatttagtggcatctacgtcgggtacttccccggggtccctgaccgtattccggtggcnggtggatcgtagggactaaatttcactctcaacccatacaatagcctgcgaggtctagaaagtagtggtggctagtactttattagttgtctagtctaaattattaacttactttcttaccgtttaccgtattaccgtttaaaccgttttcgggacccgtaacgggggtaacccgtagggtcccgttaggggaatacgttacgaacggtaaccggtaaacgtttacgggg

SEQ ID NO: 390209 - DNA, 572 bp, Homo sapiens
  misc_feature: GZ8MTXP02F7J2X.11.76.G10.1.454.CMB.2.raw
  modified_base (303)..(303): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagtattccctggctgtgtctcgtgggcgagacggccaccatcaactgacaagtccagtcagaattctttagactattccaatagagagtatttgttagttggtaaccaacagaacgccaggccagcctacaaagcagctntatttagtggctatctacgtcgggtacgttccccggggtccctgaccgtattcccggtgctggtggatcgtagggaactaaatttcactctacacctatacaatacgcctgacgaggctagaagtagtgtggacgtagtactttaattagttacgtacgatactaaattattacttacttcttacttcctattcttacgtttacggaccgtacgggggtaccctaggtcggtacggtaagtacgttacgaacggtaacgtaacgtcggg

SEQ ID NO: 390210 - DNA, 603 bp, Homo sapiens
  misc_feature: GZ8MTXP02GFVNC.11.76.G10.1.454.CMB.2.raw
  modified_base (278)..(278): a, c, t, g, unknown or other
  modified_base (362)..(362): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtcctccagacttcccgtggctgtgtctcgtgggcgagacggccaccatcaactgacaagtccagtcagtaattctttagacttattccactaagagagtatttgttagttggtaaccaanagaagccaggccagcctaccaaagcagctactatttagtggctatctacgtcgggtactccccggggtcctgaccgtattccgngcagtgatcgtaggactaaagtttcactactcaccatacaatacgactgactaggctagaagtatggtggactagttactttaagttattacggtactaaggtaactaaatttattaaactttaacctttccttaccgtttacccgtaattacctttaacggtttttacgggacccgtaaacgggggacccctaagggtccgttaggggataacgtacgaacggtaaccggttaactgggg

SEQ ID NO: 390211 - DNA, 605 bp, Homo sapiens
  misc_feature: GZ8MTXP02IQHIL.11.76.G10.1.454.CMB.2.raw
tcagcgagagataccacgaccggtgctcgatttagtcactcatacagggggagctacaacaggcaggcaggggcagcaagatggtgttgcagacccaggtcttcatttctctgttgctctggatctctggtgcctggcggagacatcgtgatgacccagtctccagtacttcccgtggctgtgtctcgtgggcgagaccggccaccatcaactgacaagtccagtcagtaattctttagactatccaactaagagagtatttagttagttggtaaccaacagaacgccgaggccagcctaccaaagcagctactatttagtggctatctacgtcgggtacttcccccggggtccctaggaccgtattccggtggcaggtgatcgtaggaactaaagtttcactcctacacctatacaaatcgcctgaccaggtctagaagtagtcggtggactagtactttaattacgttagtaccagtaactaaatttatttaactacctttacttcctttaccgaatttcgttaaaccgttttcgggacccgtaacgggggtacccaagggtcgtaggggaactacgtacgaacggtaaccggtaactcgggg

SEQ ID NO: 390212 - DNA, 560 bp, Homo sapiens
  misc_feature: GZ8MTXP02I95YQ.11.76.G10.1.454.CMB.2.raw
  modified_base (351)..(351): a, c, t, g, unknown or other
  modified_base (355)..(355): a, c, t, g, unknown or other
  modified_base (362)..(362): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcagacggccaccatcaactgcaagtccagtcagaattctttagactatccactaagagagatttgttagttggtaccaacagaagccaggccagcctaccaaagcaagctctatttattgggcatctacgtcgggattccccggggtccctgaccgtattccgnggcngtgatcnggacaaattcactctcacatacaatagctgcaggactagaagtagtagtggtacctagtacctttattaagttgtactacgtataaattatttaatactttcgttcttaccgtacttactacgtttttacgggaccctacgggggtaccaaacgggtccgttaggggagtaccttagaacgaacccgtaaacgtcggg

SEQ ID NO: 390213 - DNA, 552 bp, Homo sapiens
  misc_feature: GZ8MTXP02G9XVA.11.76.G10.1.454.CMB.2.raw
  modified_base (271)..(271): a, c, t, g, unknown or other
  modified_base (427)..(427): a, c, t, g, unknown or other
  modified_base (460)..(460): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagacttccctggctgtcgtctcgtgggcgagaccggccacatcaactgacaagtccagtcagtattctttagactatcactaagagatatttgttagttggtaccaanagaagccaggccacgcctacgaaagcagctctatttatggcatctacgtcgggtacttcccccggggtcctgaccgtagtccgtggctgtgactcgtaggactaatttcactctacaccatacaatcgctggctacgggctagaagagtggtacgntacgtactttagttattcgtcgaatataaattnttaatcgttactccttaccgtatccgttactttcggaccgtacggggcccttaaggccgttaggaactactacgaaacgaccgtaagttcgg

SEQ ID NO: 390214 - DNA, 532 bp, Homo sapiens
  misc_feature: GZ8MTXP02G6E8D.11.76.G10.1.454.CMB.2.raw
  modified_base (402)..(402): a, c, t, g, unknown or other
  modified_base (418)..(418): a, c, t, g, unknown or other
  modified_base (510)..(510): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacgccacatcaactgcaagtccagtcagaattctttagacttacttaccactaagagagtatttgttagttggtaccaactagaagccaggccagcctacaaagcagctcatttatggctatctacgtcggtagttccccggggtccctgaccgtagttccgtggctggtgatcgtgggactaatttcactctcacatcaatgcctgacnggctagagatgtaggntagtcttatatgtacagactaattagtacttacttcttctacgtatcgttacgtttcggacctacgggggcctaagggtcgttaggaacgtntaccgaaggtaccgaattcggg

SEQ ID NO: 390215 - DNA, 560 bp, Homo sapiens
  misc_feature: GZ8MTXP02F8RZK.11.76.G10.1.454.CMB.2.raw
  modified_base (271)..(271): a, c, t, g, unknown or other
  modified_base (363)..(363): a, c, t, g, unknown or other
  modified_base (429)..(429): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgacaagtccagtcagtaattctttagactatccataagagatattgttagttggtaaccaanagaagccaggccagcctacaaagcagctctatttagtggctatctacgtcggggtacttcccccggggtccctgaccgtacttccggtggcnggtggactcgtagggaactaaagtttcactctcacctatacaatacgctgcaggctagaagagtgngactagtcttattatcgtactagactaattattacttacttctcttaccgtattcttacgtttacggaccgtaacgggggaccctagggtaaccgtaggggaactacgtacgaacggaccgtaacgttcgg

SEQ ID NO: 390216 - DNA, 546 bp, Homo sapiens
  misc_feature: GZ8MTXP02JPPKP.11.76.G10.1.454.CMB.2.raw
  modified_base (270)..(270): a, c, t, g, unknown or other
  modified_base (363)..(363): a, c, t, g, unknown or other
  modified_base (419)..(419): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagattctttagactattccactaagagagatttgttagttggtaccaanagaagccaggccagcctacaaagcagctactatttagttgggctatctacgtcggggtattccccccggggtccctgaccgtattccgtggcngtggatcgtagggactaaatttcactctcacctatcaatacgctgcaggctagaanagtgtggcagtcttattattgtacagtcaattattatacttcttctcgtattctacgtttcggaccgtacggggtacccagggtccgtagggtaacgacgttacgaacggtaacgtaaacgttcggg

SEQ ID NO: 390217 - DNA, 595 bp, Homo sapiens
  misc_feature: GZ8MTXP02FY138.11.76.G10.1.454.CMB.2.raw
  modified_base (271)..(271): a, c, t, g, unknown or other
  modified_base (369)..(369): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctcgtggggcgagaccggccaccatcaactgcaagtccagtcagtatctttagactatccaactaagagagtatttgttagttggaccaanagaagccaggccagcctacaaagcagactctatttagtgggctatcctacgtcgggtacgttcccccggggtccctggacccgtagttccggtcggcnggtggattcgagggaactaacgtttcactctacaccatacaatcgcctgacgaggtctagagtacgttggacggtactagttactttagttaagttcgtactacgtattaaatttacttaacttactttcttaccgttactacttacttaccgtttcgggaccgttaacgggggacctagggtaacgtacgggaacgtacgtacgaacggtaacgtaacgttcggg

SEQ ID NO: 390218 - DNA, 601 bp, Homo sapiens
  misc_feature: GZ8MTXP02IGT4U.11.76.G10.1.454.CMB.2.raw
  modified_base (258)..(258): a, c, t, g, unknown or other
  modified_base (331)..(331): a, c, t, g, unknown or other
  modified_base (375)..(375): a, c, t, g, unknown or other
  modified_base (409)..(409): a, c, t, g, unknown or other
tcagcgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatacaactgacaagtccagtcaagaattcttttagacttacttcccactaagganagtatttgttagtttggtaaccaacagaacgccaggccagcctaccaaagcagctacatttatggcatctacncgggtacttccccggggtccctgaccgtattccggtggcgtagngatcgtggggaacctaagtttacactctcaaccntactatgacctgacagacgtagaacgtatggtgacgtagtacgtttaatatttagactaacggacaaagtttaacttattaacttacctttcttaccgtattccgttaacgtttttcgggacccgtaacgggggtaaccgttacgggaaccgttacgggtagaacttacgaacggtaaccgaaacgttcggg

SEQ ID NO: 390219 - DNA, 613 bp, Homo sapiens
  misc_feature: GZ8MTXP02HX2H1.11.76.G10.1.454.CMB.2.raw
  modified_base (231)..(231): a, c, t, g, unknown or other
  modified_base (268)..(268): a, c, t, g, unknown or other
  modified_base (407)..(407): a, c, t, g, unknown or other
tcagcgagagataccacgaccggtgctcgatttagtcactcatacaggcatacagggggcagcaagatggtgttgcagaccccaggtcttcatttctctgttgctctggatctctggtgcctgcggagacatcgtgatgacccagtctccagattccctggctgtgtctcgtgggcgagcggccacatcaactgacaagtccagtcagaatctttagactattcatagagntattgtagttgacaacagaagcagcagcctacaaagnagctcatttactggcaatctaacgtcgggtaacttcccggggtaccctgaccgtacgttccccggtaggaccgtagtgggattccggtagggtaactaaatttttcaacgttcctactaccaacgttacaaacgttacnccgtgacgacggatagaacgtagtaggtcgactacgttatttaatttagttcgtacgtaattaactaagtttaactttacgttacctttccttaaccgttaccgtaacgttcgttaacggtttacggaccggtaacggggacctagggtcgtacgggacgtaactacgaacggtaacgacgttacggtacgtcctacgtaccgtac

SEQ ID NO: 390220 - DNA, 517 bp, Homo sapiens
  misc_feature: GZ8MTXP01C21U6.52.86.H09.1.454.CMB.2.raw
  modified_base (237)..(237): a, c, t, g, unknown or other
tcagcgcagtacgacacgaccggtgctcgatttagtgctatagacttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtacagcagagcggcagccctgtgtggtgatgtataaagacactgagaggccctcaggggatccctgagcgattcctctggctccgaggtcagggcaaacgggtcacatggccatcagtggagtccaggcaggaggacgaggctgactattattgtcaaatcaaacagacaccattggtacttatgtacttcggaactgcgaccaaaggttcaacccggtcgttcgggttcacgccccaaggcccaaccccacgttcgttcaacgttccc

SEQ ID NO: 390221 - DNA, 495 bp, Homo sapiens
  misc_feature: GZ8MTXP01B2NY0.52.86.H09.1.454.CMB.2.raw
  modified_base (235)..(235): a, c, t, g, unknown or other
  modified_base (301)..(301): a, c, t, g, unknown or other
  modified_base (401)..(401): a, c, t, g, unknown or other
  modified_base (457)..(457): a, c, t, g, unknown or other
tcagcgcagtacgacacgaccggtgctcgatttagtgctatagacttgggtttggggtgggtccaggaggcagaatctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatgacagtagaagccggcaggcccctgtgtggtgatgtataaagacactgagagccctnagggatccctgagcgattctctggctcgaggtcaagggacaacggtcacatggccatcagtgagtccagcagagacgaggctgactatatgtacatcaanagacaccattgtacttatgtcttgaactgaacgacaaggtcaccgtcctgggttcncgacccaaggccaaccccgatcgctaacgttcttcccg

SEQ ID NO: 390222 - DNA, 526 bp, Homo sapiens
  misc_feature: GZ8MTXP01D46X9.52.86.H09.1.454.CMB.2.raw
  modified_base (239)..(239): a, c, t, g, unknown or other
  modified_base (431)..(431): a, c, t, g, unknown or other
  modified_base (509)..(509): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgtggtgatgtataaagacactgagacggccctcgagggatccctgagcgattccctcgtggctccgagtcagggaacaacggtcacagttggaccatcagtgagtccgaggcagagacgaggctgactattagtgtacaatcaaacagacaccnttggtacttatgtacttcggatcgcgactaaagggttccaaccgtcttacgggttcacgcccaacggcccaaaccccngttctccaaccttcccg

SEQ ID NO: 390223 - DNA, 556 bp, Homo sapiens
  misc_feature: GZ8MTXP01C2BZH.52.86.H09.1.454.CMB.2.raw
  modified_base (239)..(239): a, c, t, g, unknown or other
  modified_base (447)..(447): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggcaggcccctggtgtggtgatgtataaagacactagagacggccctcgagggactccctgagcgattccctctggctcccgaggtcgaagggaacaacgggtcaactagttcgggaccatcgagttggacgtccgaggcaggaggtacggagctagattattattgactaaatccaaaanacgacacgtagttagtaacttgtcgtacgtacgaatcgacgaacgtacgttccgtaccgtcgttacggcaccgaacccgaacgcccaaccctcgttacgtccttcgtcg

SEQ ID NO: 390224 - DNA, 517 bp, Homo sapiens
  misc_feature: GZ8MTXP01AEHDC.52.86.H09.1.454.CMB.2.raw
  modified_base (239)..(239): a, c, t, g, unknown or other
  modified_base (510)..(510): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcaggggatccctgagcgattccctctggctccaggtcagggcaaacgggtcacattggccatcagtggagtccaggcagaggacgaggctgactattattgtcaatcaacagacaccattggtacttagtgtcttcggaactgcgacgaaggttcaccgtcttgggttcacgcccaaggcccaaccccgacttgtccncgttccc

SEQ ID NO: 390225 - DNA, 617 bp, Homo sapiens
  misc_feature: GZ8MTXP01D1QJV.52.86.H09.1.454.CMB.2.raw
  modified_base (242)..(242): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagttcgtccccaggacagacggccaggatcacctgctctggagatgcattcgaccaaacgntatgtcttattggtaccagcagaagccggcacggccctgtgttggtgatagtaataaagacactgagacggccctcgagggactcccgtgagcgtatttcctctggcctccgaggtacgagggaacaacggtcacgtattcggaccatcgagttggacgtccgagggcaaggacggacgaggtctacgtaacttatttaagttcgtactaaacttacaaacaacggaacctacctagtttacggttaaactttagttcgttacttacgggaacttcggaccgaaccgtaaacggttccaaccgggttccgttacggggttccaacgaaccccgaaacggccccaaaaccccgtcgttacgtccttaaccgttccg

SEQ ID NO: 390226 - DNA, 589 bp, Homo sapiens
  misc_feature: GZ8MTXP01EIMBU.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtaataaagacactgaagacggcccctcgagggactcccgtgacgcgtatttccctcgtgggcctccgaggtacaaggggaacgaaacgggtcaaccaagtttcgggccctagtccaaggttggaacgtcccgaggcaggaaggacgaggctgactattattgtacaaatcaaacagacacctattggtaacttagtcgttctcgggaactggacgttaccgaaaggttcccgtaaccggtccgttcggggccacggccccgaaacggccccaaaacccctcttacgtccaaccgttcccg

SEQ ID NO: 390227 - DNA, 521 bp, Homo sapiens
  misc_feature: GZ8MTXP01BO6C6.52.86.H09.1.454.CMB.2.raw
  modified_base (241)..(241): a, c, t, g, unknown or other
tcagcgcagtacgacacgaccggtgctcgatttagtgctatagacttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctcagggatccctgagccgattctcgtgctccaggtcagggacaacggtcacattggccatcagtggagtccaggcagaggacgagctgactagttattgtacaatacaacagacacctattggtacttatgtcttcggaacttgacgaccgaaaggtccaccgttcgttcgggtcacgaacccacggcccaaccccaacttcgtaaccc

SEQ ID NO: 390228 - DNA, 589 bp, Homo sapiens
  misc_feature: GZ8MTXP01A7BLC.52.86.H09.1.454.CMB.2.raw
  modified_base (303)..(303): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggcgtggtccaggctggggaggtccctgagactctcctgtgcagcctctggattcacctcagtacccatgaaatgcactgggtccnccaggctccaggcaagggggctgggagtgggtgcagtatatccctatgatggaagcaataagcactacgcagagtccgtagaagggccatcgacatctaccagacgacaactacgaaagtaattaccggttacttactaaactaaatcgaaacagaccgtagaagagcgtaggaacggacaacgggtcttaagttcgttttaacgtggttaggaccgggttaagggacgggggtaaaccttccgggtaatttaaccgacggaccgtaacggcccccgttaaacggg

SEQ ID NO: 390229 - DNA, 516 bp, Homo sapiens
  misc_feature: GZ8MTXP01DGLIQ.52.86.H09.1.454.CMB.2.raw
  modified_base (242)..(242): a, c, t, g, unknown or other
  modified_base (323)..(323): a, c, t, g, unknown or other
  modified_base (426)..(426): a, c, t, g, unknown or other
  modified_base (433)..(433): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgcattgaccaaacgntatgcttatggtaccagcagaacgccggcaggccctgtgttggtgatagtaataaagacactgagagccctgaggatcccngagccgattctgtggctaccgaggtcgaaggggaacaacgggtcactagttcggccatcaggtggagccaggacagagacgagctgattattattgtacaaanacaacanacactatagtatatcgtcgtcgtacgcgacgacgaacgtacgacgttcgttcgtcgacgaaccgaccgaccacctaacgcgtc

SEQ ID NO: 390230 - DNA, 595 bp, Homo sapiens
  misc_feature: GZ8MTXP01EXJF8.52.86.H09.1.454.CMB.2.raw
  modified_base (222)..(222): a, c, t, g, unknown or other
  modified_base (239)..(239): a, c, t, g, unknown or other
  modified_base (279)..(279): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtacagcagagccggcagccctgtgtggtnatgtataagacactgagacggccctcgagggtactcccgtgacgcgtattcccgtcgtggctccgaggtacaacgggaaccaacgggtcaaccgtagttcgggaccagtcgagttggaacgttccgagggccaaggaggacgaggctagacttattattgtacaatacaaacacgacaccgtagtttacggtacttacgtgttacgttacggaaacttcggaccgaccgtaaaggttccgtaacccgtccgttcggggttacaccggaacccgaacggccccaaaccccgtacgttacgtccgaaccgtttccccg

SEQ ID NO: 390231 - DNA, 525 bp, Homo sapiens
  misc_feature: GZ8MTXP01DEDOM.52.86.H09.1.454.CMB.2.raw
  modified_base (285)..(285): a, c, t, g, unknown or other
  modified_base (436)..(436): a, c, t, g, unknown or other
  modified_base (489)..(489): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtacagcagaagccggcaggcccctgtgttggngatgtataaagacactgagaggccctgagggactccctgagccgattctcgtggctcccgagggtcaggggacaaacgggtcacattggccatcagtggagtccagggcaggaggacgaggctggaacttagttattgtacaaatcaaacngacacattgtacttatgtcttaacggaattgacgacgtaaaggtcacgttccngggtccacgcccgaaaggcccaacccgtcttgtccc

SEQ ID NO: 390232 - DNA, 516 bp, Homo sapiens
  misc_feature: GZ8MTXP01A5EII.52.86.H09.1.454.CMB.2.raw
  modified_base (240)..(240): a, c, t, g, unknown or other
  modified_base (422)..(422): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgtggtgatgtataaagacactgagaggccctcgaggggactccctgagcgattcctctggctccaggtcagggcaacgggtcacattggccatcagtgagtccaggcagaggacgaggctgactattattgcaatcaaacngacaccattggtaacttatgtcttcggaactgcgacctaagggttcaccgtcgttgggttcacgcccaaggcccaacccacttgtccaacttcc

SEQ ID NO: 390233 - DNA, 574 bp, Homo sapiens
  misc_feature: GZ8MTXP01BOY02.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaaaccgatatgtcttattggtaccagcagaagccggccaggcccctgtgtggtgatgtataaagacatgagacggccctgaggactccctgacgcgatttcctctggctccgaggtcagggcaacgggtcacagttcggccatcagtggacgtccgaggacaggaggacgaggctagacttattattgacaaatcgaaacagaacctaccagttacggtactttatcgttacttacggaattggacgaaccgtaaacggttccgaaccggttaccgttcgggggttccaacggccccgaaacggccccaaaccccacgttcgttccaaccgtttccccg

SEQ ID NO: 390234 - DNA, 520 bp, Homo sapiens
  misc_feature: GZ8MTXP01DNG5Z.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggccccctgtgttggtgatgtataaagacactgagaggccctcagggatccctgagcgattcctctggctccaggtcagggcaacgggtcacattggccatcagtggagtccagggcagaggacgaggctgactattattgtcaatcaacagaccaccattggtacttatgtcttcggaactgcgaccaagggttcaccgtccttggggttcaggcccaagggcccaaccccgcttgtccaacgttcc

SEQ ID NO: 390235 - DNA, 523 bp, Homo sapiens
  misc_feature: GZ8MTXP01D5LBC.52.86.H09.1.454.CMB.2.raw
  modified_base (508)..(508): a, c, t, g, unknown or other
  modified_base (517)..(517): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaacgatatgcttattggtaccagcagaagccgggccaggcccctgtgttggtgatgtataaagacactgagaggcccctcgagggactcccgtgagcgattcctctggctccaggtcagggaacaacgggtcacattggccatcagtgagtccaggcagaggacgaggctgactattattgtcaattcaaacagacacctagttggtaacttatgtcttcggaactgcgacaaggttcaccgtcttagggttcacgcccaaggcccaaaccccncttcgtccncttccg

SEQ ID NO: 390236 - DNA, 531 bp, Homo sapiens
  misc_feature: GZ8MTXP01DU48C.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgttggtgatgtataaagacactgagaggccctcgagggactcccgtgagcgatttcctctggctccgaggtcagggcaacgtcactatggcatcagtgagtccaggcagaggacgaggctgactattattgtacgtaatcaaacagacaaccgtattggtaacttatgtcttacggaactgcgaacgaacggttcaaccgtcgttcgggttcacgccccaaaggcccaaacccgcttcgtcaacgttccg

SEQ ID NO: 390237 - DNA, 516 bp, Homo sapiens
  misc_feature: GZ8MTXP01ES9K3.52.86.H09.1.454.CMB.2.raw
  modified_base (231)..(231): a, c, t, g, unknown or other
  modified_base (268)..(268): a, c, t, g, unknown or other
  modified_base (474)..(474): a, c, t, g, unknown or other
tcagcgcagtacgacacgaccggtgctcgatttagtgctatagacttggggtgggtccaggaggcagaactctgggtgtctcaccatggcctggatccctctacttctcccctcctcactctctgcacaggctctgaggcctcctatgagctgacacagccacctcggtgtcagtcgtccccaggacagacggccaggatcacctgctctggagatgcattgaccaaacgntatgcttatgtacagcagagcggcaggccctgtgtgngatgtataaagacactgagacggcctgagggatccgtgagcgattctcgtggctccgaggtcaagggacaacggtcacgattcgggacctatcgaagtggacgtccgagggcgaaggaggaacgagggctagaacttattaattgtacaatcaaacagaccacattgtacttatgtctcgatgcgacacggtcacgtctgggttcncggcccaaggcccaaccctacgcgttactaacttcgttcccg

SEQ ID NO: 390238 - DNA, 508 bp, Homo sapiens
  misc_feature: GZ8MTXP01B4BU5.52.86.H09.1.454.CMB.2.raw
  modified_base (473)..(473): a, c, t, g, unknown or other
  modified_base (496)..(497): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattccctctggctccaggtcagggcaacgggtcacagttgccatcagtgagtccaggcagaggacgaggctgactatattgacaatcaacagacacctattacggtacttatgtcttcggaactcgcgactaaggttcaccgtcngggttcacgcccaggccaacccnncgtcaacgtcc

SEQ ID NO: 390239 - DNA, 558 bp, Homo sapiens
  misc_feature: GZ8MTXP01DMEKC.52.86.H09.1.454.CMB.2.raw
  modified_base (284)..(284): a, c, t, g, unknown or other
  modified_base (427)..(427): a, c, t, g, unknown or other
  modified_base (434)..(434): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacgccaggatcacctgctctggagatgcattgccaaacgatatgcttatggtaccagcagaagccgggcaggcccctgtgttggnatgtaataaagacactgagaggccctgaggactcccgtgacgccgattctcgtggctaccaggtcaggggacaacgggtcacgattggaccatcgagtggagtccgaggacgagaggacgtaaggctaggactattattgtanaatcaanagacacctatttggtacttagtcgtcttaacggaacttcgacgaaccgtaaggtccttaacccggttccgttaggggtccaacggaaccccgaacgggaccccaaaccccgtcttcggtaaccc

SEQ ID NO: 390240 - DNA, 524 bp, Homo sapiens
  misc_feature: GZ8MTXP01DJ325.52.86.H09.1.454.CMB.2.raw
  modified_base (238)..(238): a, c, t, g, unknown or other
  modified_base (505)..(505): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggacagcagagccggcaggccctgtgttggtgatgtataaagacactgagaggccctgagggactccctgagcgattcctctggctccaggtacagggaacaacggtcacattggccatcagtgagtcgaggcagaggacgaggctgactattatgtacaatacaacagacactattggtaacttagtgtcttcggaactgacgaccaaggttccaaccgtcgttcggggttcacgaacccaacggaacccaaccccncgttcgtccaaccttcccg

SEQ ID NO: 390241 - DNA, 515 bp, Homo sapiens
  misc_feature: GZ8MTXP01DZCPT.52.86.H09.1.454.CMB.2.raw
  modified_base (241)..(241): a, c, t, g, unknown or other
  modified_base (339)..(339): a, c, t, g, unknown or other
  modified_base (403)..(403): a, c, t, g, unknown or other
  modified_base (478)..(478): a, c, t, g, unknown or other
  modified_base (503)..(503): a, c, t, g, unknown or other
  modified_base (511)..(511): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctggagatgcattgaccaaacgntatgtacttattggtaccagcagaagccgggcacggccctgtgttggtgatgtataaagacactgagacggccctcgagggatccctgagcgattccnctggctcaggtacagggaacacggtcacattcggcatcagtgagtccgaggcagaggacgagcngactattattagtacaaattcaaacagacacctagttggtaacttatgtcttcgaatgcgacaggttcaccgtcngggttcacgccaaggccctaacccncttctccnctcg

SEQ ID NO: 390242 - DNA, 633 bp, Homo sapiens
  misc_feature: GZ8MTXP01DOMER.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcactgctctggagatgcattgaccaaaccgatatgcttattggtaccagcagaagccggcagccctgtgttggtgatgtataaagacactgagacggccctagagggactcccgtagacgtcgtacttttcccgtttagggctaccgaagggttaccgaaaacgggggaacctaaccggggttcaaacgtaagtttcgggaccctaagttccgaaaggttcgggacgtccgaagggcgaaaggacgggaacggagggtcctaggtaacttattaagttagttacaaagttacaaacgtagtaaccaacctagtttacggtaactttaagtcgttacgttacggaactcgaacgaacgaaaggtccaaccgtcgtgggttaccacgaccccgaaggcccaacccgacgtcacctaacttcgttcccg

SEQ ID NO: 390243 - DNA, 575 bp, Homo sapiens
  misc_feature: GZ8MTXP01CQTAJ.52.86.H09.1.454.CMB.2.raw
  modified_base (240)..(240): a, c, t, g, unknown or other
  modified_base (448)..(448): a, c, t, g, unknown or other
  modified_base (473)..(473): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaaccgntatgtcttattggtaccagcagaagccgggccaggcccctgtgttggtgatgtaataaagacacgtagagacggccctacgagggactcccgtgaacgcgtatttccctcgtggctaccgaggtaccgaaggggaacaaacgggtcaacgtagttcggccatcgaagtggagtccgaggcaaggaggacgaggctgactattattganaatcaacagacactattggtacttntagtcgttacgaatcgacgaccgtaaggttccgtaaccggtcgttacggggttccaacggaaccccgaacggccccaaacccgcttcgtccttaacttcccg

SEQ ID NO: 390244 - DNA, 504 bp, Homo sapiens
  misc_feature: GZ8MTXP01ET7S4.52.86.H09.1.454.CMB.2.raw
  modified_base (468)..(468): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtacagcagaagccggcaggcccctgtgttggtgatgtataaagacactgagaggccctcgagggatccctgagcgattcctctggctccaggtcagggcaacggtcacattggccatcagtgagtccaggcaggaggacgaggctgactattatgtacaatcaaacagaacacctattggtacttatggtcttcgggactgcacgaaggttcaccgtcngggttcacgcccaggcccaacccattcgtcaactcc

SEQ ID NO: 390245 - DNA, 526 bp, Homo sapiens
  misc_feature: GZ8MTXP01EBIQU.52.86.H09.1.454.CMB.2.raw
  modified_base (280)..(280): a, c, t, g, unknown or other
  modified_base (337)..(337): a, c, t, g, unknown or other
  modified_base (510)..(510): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagagccggcaggccctgtgtggtnatgtaataaagacacgtagaagacggcccctcgagggactcccgtgagcgtattccnctggctccgaggtcaagggcaacggtcacgtattcggccatcagtgagtcgagcagaggacgaggctgactattatgtacaatcaacagacacctagttgtacttagtgtcttcggaactgacgactaagttcgaccgtcttgggttcacggaacccaacggcccaaccccgnttacgtccaacgttcc

SEQ ID NO: 390246 - DNA, 619 bp, Homo sapiens
  misc_feature: GZ8MTXP01DSD7G.52.86.H09.1.454.CMB.2.raw
  modified_base (230)..(230): a, c, t, g, unknown or other
  modified_base (273)..(273): a, c, t, g, unknown or other
tcagcgcagtacgacacgaccggtgctcgatttagtgctatagacttggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctggagatgcattgaccaaacgntatgctttatggtaccagcagaacgcggcagccctgtgtggtnatgtaataaagacactggaagacggccctcgagggtactcccgtgacgcgattctctggctcgagtcgaaagggactaacgggtcaacgtattcggacctagtcgaagttgggacgtcccgagggacaagggacgggaacggacgggtactagggaacttaagtttaagttacgtacctaaagttacccaaaacgtaacgaaaccaacccgtaagtttacggtaacctttaagtcgttacgttacggaaactcggtaacgaaaccgttagggtccaaccggttcgtgggttaccacggaccccgaaggtaccccaaaccctctcgttacctaacgttccgttcccg

SEQ ID NO: 390247 - DNA, 576 bp, Homo sapiens
  misc_feature: GZ8MTXP01A1NR9.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtaataaagacactgagacggccctacgagggactcccgtgagcgatttccctcgtggcctccgaggtacgacggggtaaccaacgggtcaacagtttggaccagtcgagtggacgtccgagggcaggaggacgtaggctagactattattgacaatcaaacagaccaccagttggtaacttgtgtcgttacggaaactcgacgttaccaaagggttccaacccggtcgttgggttcacgaacccgaacgggccccaaaccccgtcttacgtaacttaagtccccg

SEQ ID NO: 390248 - DNA, 604 bp, Homo sapiens
  misc_feature: GZ8MTXP01EEU9I.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtaataaagacactaggagacgggcccctacgaggggactccctggagtcgtatttcctcgtggctccgaggtaccgaagggaaccaacgggtcactagttcgggaccatcgagtggacgtccgaggcaggaggtacgaggctagacttattattgtacaatcaaacacgacacctagttgtaacttatcgttacttacgggaaactcggtaccgaccgtaaacggttccgtaaccggttcccgttacgggttccaaccggaaccccaaacgggtccccaaaccccctagttcgtccccgttaacgtttccccg

SEQ ID NO: 390249 - DNA, 605 bp, Homo sapiens
  misc_feature: GZ8MTXP01BM4I6.52.86.H09.1.454.CMB.2.raw
  modified_base (243)..(243): a, c, t, g, unknown or other
  modified_base (246)..(246): a, c, t, g, unknown or other
  modified_base (256)..(256): a, c, t, g, unknown or other
  modified_base (277)..(277): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaacgntangcttatgacngcagagcgcagccctgtgtgnatgtataaagacagtgagacggcctgaggactcccgtgacgccgtattcgtcgtggcctaccgagggtcgaagggtacaaacgggtcaactagttcggacctatacgaggtaggacgtccgagggacaagggacggacggaaggcctagaacttagttagtacgttaacaactacgaaactacgaactaccgtaagttcggtaactttacgtcgttacttaacgggtaacttcgggtacccgaaaccgtaaacggtccaacccgggttccttacggggtcccaacggccccgaaacgggaccccttaaaccccgtcgttcggtaaccc

SEQ ID NO: 390250 - DNA, 593 bp, Homo sapiens
  misc_feature: GZ8MTXP01EENNR.52.86.H09.1.454.CMB.2.raw
  modified_base (244)..(244): a, c, t, g, unknown or other
  modified_base (285)..(285): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgcattcgaccaaacgntatgcttatgtaccagcagagccggcacgccctgtgttggngatgtaataaagacacgtgagacggccctacgagggactcccgtgacgcccgtattctcgtcggcctaccgaggtcgagggaaccaacgggtcaacgtagttcggacccagttacgaggtggacgtccgaggacagggaggacgagctagaacttagttagtgtaacaatacaaacgacacactaagttcgtactttagtcgttcctaacgggaacttcggaaccgttaaccgtaaacggttcccaacccggttcgttacggggtaaccacgaaccccgaacggaccccaacccctgttccgtaaccc

SEQ ID NO: 390251 - DNA, 666 bp, Homo sapiens
  misc_feature: GZ8MTXP01BJLBQ.52.86.H09.1.454.CMB.2.raw
  modified_base (658)..(658): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaacgccgggccacggcccctggtgtggtgatgtaataaagacactagaagacggcccctgaagggactccccgtaggacgcgtactttccgtcgtggctacccgaggtacaagggaacaaacgggtcacgtaagttcggacctagtcaaggtcggacgaccgagggaccaagggacgggaacgagggtacccttaggaaacctttaagtttagtttcggtaacgtaaacttaccaaaacgaacggaaaccctaaccggggtaattttacggggttaaacctttagttacggttacgtttaccgggaaacttcggaccgttaaaccgtaaacgggttccaacccggtcgttcgggttccacggaaccccaacggtcccaacccgtacttcgtaacccncgttcccg

SEQ ID NO: 390252 - DNA, 658 bp, Homo sapiens
  misc_feature: GZ8MTXP01DH1XZ.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccacggccctgtgtggtgatagtaataaagacactggagacggccctcgagggactcccgtgagcgtattccctctggctccgaggtacgaagggtaacaaacgggtcaacgtagttcgggacctagtcgaaggttggaacggtcccgaagggccaagggaacgggacgagggcctaggaacttagttattcgtacaaactacaaacacgactaacctagtttagggtaacctttagtcggttacgttaccggaaacgttcggaccgttaaccgtaaacggggttccctaaccccgggttccgttacgggggttcccaaccgggtaacccccgaaaacggggcccccaaaacccccgtcttacccggttaacccgaacccgttttcccccg

SEQ ID NO: 390253 - DNA, 726 bp, Homo sapiens
  misc_feature: GZ8MTXP01AO2KW.52.86.H09.1.454.CMB.2.raw
  modified_base (242)..(242): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaacgntatgtcttatggtaccagcagaagccggcacggccctgtgtggtgatgtataagacactgagacggccctagagggactcccgtagacgcgtatttccccgtcgtggccttaccgaggtaccgaacggggtaacctaaaccgggtcaacgtaacgtttcgggaccctagtccgtagggttacggaacggtcccgaagggacctaaggggaacggggaacggacgggtccgtaggtaaacctttaagtttaagtttacggtaacgtaaacgttaccaaaaccgtaacggaaaccctaacccgttaagtttacgggtttaaaccctttaagttccggtttaccgtttaacgggaaaccttcggaacccgttaaaccgtaaaccgggttcccgtaaacccggttccggttacgggttaccgaccggaaccccgaacgggtaaccccaaaccccggtcttaccggttaacccttaaccggtttccccg

SEQ ID NO: 390254 - DNA, 561 bp, Homo sapiens
  misc_feature: GZ8MTXP01CB8LL.52.86.H09.1.454.CMB.2.raw
  modified_base (238)..(238): a, c, t, g, unknown or other
  modified_base (438)..(438): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagccggcagccctgtgtggtgatgtataaagacactgagaggccctcgagggactcccgtgacgcgatttccctctggctccgaggtaccgagggaacaacgggtcacgtagttcggcccaatcgagtggagtccgaggcaaggaggtacgaggctagactattattgtacaatcaaanagacacctattggtacttagtgttcttacggaactcggcgaccgtaaggttccgaaccgttccgttacggggttccacggccccgaacggccccaaccccgtacttcgtcccaacgtttcccg

SEQ ID NO: 390255 - DNA, 630 bp, Homo sapiens
  misc_feature: GZ8MTXP01C862U.52.86.H09.1.454.CMB.2.raw
  modified_base (284)..(284): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaacgatatgcttatggtaccagcagaagccggcacggccctgtgttggtnatgtaataaagacactgagacggccctcgagggactcccgtagagcgtactttcctcgtggcctccgaggtcgaagggaacaaacgggtcaacgtagttcggacctagtcgagtggaacgtccgaggcaagggacggacgagggtctagacttagttattcgtactaaatacaaacgacgaacctaaccgtagtttacgggttaacctttagtcgttaccgttaccgggaaacttcggaccgttaaaccgtaaacgggttcctaaacccgggttcccgttagggggttccaaccggaaccccgaaacgggccccaaaccccgtacttcgtaaccaaccgtttcccg

SEQ ID NO: 390256 - DNA, 553 bp, Homo sapiens
  misc_feature: GZ8MTXP01DRO8Q.52.86.H09.1.454.CMB.2.raw
  modified_base (243)..(243): a, c, t, g, unknown or other
  modified_base (290)..(290): a, c, t, g, unknown or other
  modified_base (327)..(327): a, c, t, g, unknown or other
  modified_base (437)..(437): a, c, t, g, unknown or other
  modified_base (446)..(446): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgccaaaaccgntatgcttattggtaccagcagagccggcaggcccctgtgtggtgatntaataagacactgagacggccctgaaggtactcccgngacgccgtattcgtctggcctaccgaggtcgaagggtaccaaacgggtcacgattcggaccatcgagtggagtccgaaggcaggagacgaggctagactagttagtgtanaaatcaaanacgacacgtattgtacttagtcgtgtaacgaacttcgacgaacgtacggtccttaccggttcgttcggaaccaacgaacccgaacgaccccaacccgtcgttcgtcc

SEQ ID NO: 390257 - DNA, 570 bp, Homo sapiens
  misc_feature: GZ8MTXP01CA2SY.52.86.H09.1.454.CMB.2.raw
  modified_base (533)..(533): a, c, t, g, unknown or other
  modified_base (565)..(565): a, c, t, g, unknown or other
tcagcgcagtacgacacgaccggtgctcgatttagtgctatagacttgggtttgggggtgggtccaggaggcagaactctgggtgtctcaccatggcctggatccctctacttcctcccctcctcactctctgcacaggctctgaggcctcctatgagctgacacagccaccctcggtgtcagtgtccccaggacagacggccaggatcactgctctggagatgcattgaccaaaccgatatgcttattggtaccagcagaagccgggcacggcccctgtgttggtgatgtaataaagacactgagacggccctcgagggactccctgacgcgaactttccctctgggcttacccgaggtaccgaaggggaactaaacggtacactagttcgggccaatccgaagtggaagtccgaggcagaagggaccggaggacctgaacttattagttgtacaaatacaaacagtaaccaaccgtattaggttacttaagttgtcttcggaaactgacgacgtaaagttccgacgttccngggttcacgcccaagcccaacccacttcgtcncttcg

SEQ ID NO: 390258 - DNA, 626 bp, Homo sapiens
  misc_feature: GZ8MTXP01ATO45.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgtcttattgtaccagcaagaagccggccacggccctgtgtggtgatgtaataaagacacgtgagacggccctacgagggtactcccgtgacgcgtattccctctcgcctccgaggtacgaacgggaacaacgggtcacgtagttcgggaccatccgagtggacgtccgaggcaggaggacgaggctagacttagttattgtacgtaaatacaaacacgaactaaccgtagtttacggttaacctttagttcggttaccgttaccggtaaactcggtaaccgaaacccgtaacggttaccgtaacccggtccgttcggggttaccacccggaaccccgaacggaaccccctaaccccgacttccgtccttaaccgtttccccg

SEQ ID NO: 390259 - DNA, 615 bp, Homo sapiens
  misc_feature: GZ8MTXP01EB4RT.52.86.H09.1.454.CMB.2.raw
  modified_base (590)..(590): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttatggtaccagcagaacgccggcacggccctgtgtggtgatgtaataaagacacgtaggagacggccctacgagggtactcccgtaggacgcgtatttccctcgtaggtcctaccgaggtaccgaaggggaaccgtaaacgggtcaacgtagtttcgggaccctaagtcgaaggttgggacgtccgagggacaaggaggacgaggtctagacttattatgtacaagtacaaacacgaccaacgtattcggtaacttagtgttacttacggaacttcgaccgaacgtacggttccgtaacccggttcgttacgggttcaccgaacccgaacggccccaaacccncgttcgtaaccttaaccgtttcccg

SEQ ID NO: 390260 - DNA, 690 bp, Homo sapiens
  misc_feature: GZ8MTXP01AXDTN.52.86.H09.1.454.CMB.2.raw
  modified_base (226)..(226): a, c, t, g, unknown or other
  modified_base (243)..(243): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggtaccagcagagccggccaggcccctgtgttggtgatgtaataaagacactgagacggccctcgagggtactcccgtgacgtccgattctcgtcggtcctaccgagggtccgaaggggaaccaaacgggtcacgtacgttacgggaccctagttaccgaaggttcgggaacggtacccgaggggaccgaagggaacggggaaccggacggacgtaaggtactttaaggtttaagttcggtaactaaacttaccgaaaaccgaacggtaaaccctaaccgttaaagttttacgggttaaaccttttaaggttcggttaacccgttaacgggtaaacgtttccgggaacgttaacccgtaaacggtccttaaccccggttccgttacgggaaccgacgaaccccgaacgggaccccttaaaccccgtcttaacgtcccg

SEQ ID NO: 390261 - DNA, 600 bp, Homo sapiens
  misc_feature: GZ8MTXP01A17FS.52.86.H09.1.454.CMB.2.raw
  modified_base (350)..(350): a, c, t, g, unknown or other
  modified_base (360)..(360): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggatcactcagtacccatgaatgcactgggtccgccaggctccgaggcaagggggctgggagtggggtgctagttatatcccctangatgggaaanaacaaagtaagcaacgtacgacgaggtacggtcgtaggaacgggccgtagtacgacctatacctaccgagacgaacaacgtacgaaagtaacgttacgttacttactaactaaatacgaacacgacgtaggaacgagtcgtaggacggacgtaacggtcttagttacgtttacgtggtaggacggaggttacgggtaactacgtaacgttacgacgaccgtaaccgttaacccgtaacgg

SEQ ID NO: 390262 - DNA, 546 bp, Homo sapiens
  misc_feature: GZ8MTXP01EAOY6.52.86.H09.1.454.CMB.2.raw
  modified_base (434)..(434): a, c, t, g, unknown or other
  modified_base (539)..(539): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccaggcccctggtgttggtgatgtataaagacactgagaggccctcgagggactccctgagcgattcctcgtggctccaggtcaagggcaacgggtcactattcggccatcagtggagtccgaggcaggaaggacgagggctgactatttattgtacaatcaaanacgacacctagtttggtaactttagtgttcgttacggaactgcgaacaacgggttccaaccgtcgttgggttcacggcccaacggcccaaccccattcgtaaccncttcccg

SEQ ID NO: 390263 - DNA, 638 bp, Homo sapiens
  misc_feature: GZ8MTXP01CAYPQ.52.86.H09.1.454.CMB.2.raw
  modified_base (242)..(242): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggcaggcccctgtgttggtgatgtataagacactgagaggccctcgagggactcccgtgacgtccgatttctcgtcggcctcccgacgggtcgaacgggggaaccaaacgggttcactagttcgggccctagtcgaaggtggacgtcccagggacgaggaacgggacggaagggctaggacttaattaggtttgtactaaagttaccaaacacgacctaacctagtttaggtaaccttagtcgttcgttaacgggaactttacggccgaaaccgtaaacgggtcccaacccgggtttccgttacgggggttaaccaccgggaaccccgaacggggtaccccaaaccccctaacgttccggtttaacccc

SEQ ID NO: 390264 - DNA, 543 bp, Homo sapiens
  misc_feature: GZ8MTXP01CU9TW.52.86.H09.1.454.CMB.2.raw
  modified_base (219)..(219): a, c, t, g, unknown or other
  modified_base (246)..(246): a, c, t, g, unknown or other
  modified_base (278)..(278): a, c, t, g, unknown or other
  modified_base (322)..(322): a, c, t, g, unknown or other
  modified_base (454)..(454): a, c, t, g, unknown or other
tcagcgcagtacgacacgaccggtgctcgatttagtgctatagacttgggtttgggcacgaccggtgctcgatttagtgctatagacttgggtttggggctgtgggtccaggaggcagaactctgggtgtctcaccatggcctggatccctctacttctcccctctcactctctgcacaggctctgagcctcctatgagctgacacagccacctcggtntcagtcgtccccaggacagacgcaggntcactgctctggagatgcattgaccaaaccgntatgacttatggtaccagcagaacgccggcaggccctgtgtgtnatcgtataaagacactgaagacgcctgagggactccctagacgcgattctcgtggctccgagtccgaagggacaacggtcactagtcggacctagttcgacgttgggactcccgaggccaggacggaacggngtcgtagacttattaattgactaaattcgaaacagaccacttagttaacggtaacttaagtcgtacgttccggaaacttcggtaacccg

SEQ ID NO: 390265 - DNA, 565 bp, Homo sapiens
  misc_feature: GZ8MTXP01DF48U.52.86.H09.1.454.CMB.2.raw
  modified_base (289)..(289): a, c, t, g, unknown or other
  modified_base (414)..(414): a, c, t, g, unknown or other
  modified_base (548)..(548): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccgggccaggcccctggtcgttggngatgtataaagacacttgagaggccctgagggatccctgagcgtactttcctcgtggcttccgaggtacgagggaacaacggtcactattcggccatcagtggatccgagcagacggacgagcgngactaattatgttcgaaattcaaacagacacctagtttcggtaacctttatcgttcttacgggaaacttcgacgttacgaaacgttccgtaaccgtccgttcggggttcacggccccaaaggcccaaaccccgnttcgtcaaccgtttccg

SEQ ID NO: 390266 - DNA, 700 bp, Homo sapiens
  misc_feature: GZ8MTXP01DSX1T.52.86.H09.1.454.CMB.2.raw
  modified_base (293)..(293): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgctattcgacccaaaccgatatgtcttattggtaccagcagaagccgggccacggccctgtgttggngatgtaataaagacactaggagacggccctcgagggtactcccgtggacgcgtactttccgcgttggccttccgacggtccgaacgggaacgtaaacgggtcaaacgtagtttcgggacctagtcagggttcgggacgtacccgagggaccaagggaacgggacggtaggcgtagaacttaagtttaagttcgtaacgtaaacttacaaaacgacgtaaacctacccgttaagtttcggttaaactttacgttcggttaccgttaacgggtaacttaacggaacccggttaaaccggtaaacgggttcccgtaaacccggttccggttacgggggttacccaaccgggtaaccccgaaaacgggcccctaaaaccccggtcttacgtaacccgttaaccctttcccg

SEQ ID NO: 390267 - DNA, 727 bp, Homo sapiens
  misc_feature: GZ8MTXP01AMNO4.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtacagcagaagccggcaggccctgtgtggtgatgtaataaagacactgagacggccctgaggggtactccctagacgcgtacttccctcgtggtcctcccgagggttaccgaggggtaaccgaaacgggtccaactacgtttcgggacccaaatccgaaggttgggacgtacccggaagggaccgaagggtaacggggaacggaacgggtccgttagggtaacctttaagtttaacgtttaggtaaccgtaaacttaaccgaaacaacggaaacctaaccctaagtttacgggttaacctttaaagtcggtttaccttaccgggtaaacgttaacggacccggaaacccgtaaacggggttccgtaaaccccgggttaccggttcgggggttaacccttaccgggaacccccgaaaacgggtaacccccaaaacccccggtccttacccgggttaacccgttaaccctttccccgg

SEQ ID NO: 390268 - DNA, 683 bp, Homo sapiens
  misc_feature: GZ8MTXP01A0HTC.52.86.H09.1.454.CMB.2.raw
  modified_base (225)..(225): a, c, t, g, unknown or other
  modified_base (284)..(284): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgatatgcttatgtaccagcagagccggcagcccctgtgtggtnatgtataaagacactgagacggccctcgagggactccctgacgccgtattctcgtggcctaccgaggtcgagggacacgggtcacattcgggaccagttacgaaggttggacgtacccgagggaccgaaggtaagggaccggaggaccgttaggaacctttaaggttaactttcggtaacgtaaacttaaccgaaaccaaggaaccctaacccgttaagtttacgggttaacctttaaagttcgtttccgttaaccggggtaaacctttggtaacccgggaaacccgtaaaacggggtcccgttaaacccccgggtttcggtttccgggggtaaccctaaccgggtaacccccgtaaacgggggacccccaaaaccccctcggttcggtttaacccccg

SEQ ID NO: 390269 - DNA, 628 bp, Homo sapiens
  misc_feature: GZ8MTXP01D6TPP.52.86.H09.1.454.CMB.2.raw
  modified_base (610)..(610): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgtcttattggtaccagcagaagccgggccaggcccctgtgttggtgatgtataaagacactgaagaggccctcgagggactcccgtagagcgactttcctcgtggcttcccgaggtaccgaggggaaccaaacgggtcaaacgtagtttcgggacctagtaccgaaggttggtagtacccggaagggccaaggaacgggacggagggcctaggtaacttatttaagtttacggtactaaacgttacaaaaccaacgtaaccaacccgtagtttacggttaactttagtcgttacgtttacggaactcgtaccgacgaacggttcgaaccgttccgttgggttcacggaacccaacggcccaacccncttcgtccaacgttcccg

SEQ ID NO: 390270 - DNA, 623 bp, Homo sapiens
  misc_feature: GZ8MTXP01DQ79F.52.86.H09.1.454.CMB.2.raw
  modified_base (287)..(287): a, c, t, g, unknown or other
  modified_base (327)..(327): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcactgctctggagatgcattcgaccaaacgatatgtacttattggtacagcaagaacgccggcacggccctgtgtgtanatagtaataaacgacactgagacgcctagacggactccgngagcgtacttccgtcgtcgctaccgaggtaacgaacgggaaccgaacggtaccaacgtagttcggacctagtacgtaggtaggacgtaccgaggacgaggaacggtacgacgtcgtagtaacttagtttaacttcgtaacgtaaacttaacaaacgaacgaaccctaccgttaagttacgggtttaacttagttcgttaccggttacgaacgtggaaccgaacgtaacggcctaacccggtcgttcgggcaccgaacccacgaaccccaacccgtacttctaacttccttaacccg

SEQ ID NO: 390271 - DNA, 597 bp, Homo sapiens
  misc_feature: GZ8MTXP01BJQ20.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagaggcccctgggggactccccgtgagcgattctcctgggctccgaggtcaagggacaacggtcactattggccatcagtgagtccaggcaggaggacgaggctagacttattagttagtacaagtacaacgagacaacctagttaggttactttaagtcgttacgttacgggtaactggaacccgtaaacgttaacggtcccttaacccggttcccggtcggggttacccaccggaccccgaaaccgggtcccccaacccgtaccgttcgttaaccctccgttcctttcccccg

SEQ ID NO: 390272 - DNA, 557 bp, Homo sapiens
  misc_feature: GZ8MTXP01CCPOD.52.86.H09.1.454.CMB.2.raw
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgntatgcttattggtaccagcagaagccgggccaggcccctgtgttggtgatgtataaagacactgagaggccctcgagggctccctgagcgattcctctggctccgaggtcaggggaacaacgggtcacgattgggccatcaggtggacgtccagggcaggagggacgaggcgtagacttattagttcgaccaaatcaaacagacacctagttggtacttatgttcttcggaactggcgaccgaaggttccgtaacccggttccgttacgggttcacggccccaaacggccccaacccgacttcgtccaactttcccg

SEQ ID NO: 390273 - DNA, 676 bp, Homo sapiens
  misc_feature: GZ8MTXP01ELDDI.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttattggtaccagcagaagccggcacggccctgtgttggtgatgtaataaagacactgaagacgggcccctcgagggactcccgtgacgcgtagttccctcgtggcctccgagggtacgaaggggtaaccgaaacgggtccaacgagtttcgggacctagtccgaaggttgggacgtccgaggccgaaggaagggacgaagggctagaaccgttaagtttaattgtacgaaattcgaaaacgaacgaaccaaccctatttacgggtaaccttttaagtcgttaccgtttaccgggaaacgttcggtaccggaaacccggtaaacgggttcccaaacccgggtttcccgttacgggggttccaaccggtaaccccgaaaacgggtccccaaaacccccgtacgttcggttaacccgttaacctttccccg

SEQ ID NO: 390274 - DNA, 527 bp, Homo sapiens
  misc_feature: GZ8MTXP01CH76V.52.86.H09.1.454.CMB.2.raw
  modified_base (287)..(287): a, c, t, g, unknown or other
  modified_base (493)..(493): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtaccagcagagccggcaggcccctgtgttggngatgtataaagacactgagacggccctgaggactcctgagccgattctcgtgcctaccgaggtcgagggaacaacgggtcactattggacctagtcgaggtggacgtccgaggacaacggaggacggaggctagtaactagttattgtacaatacgaacagacactatgtactatgtctcggaattgcgacgaagtcaccgttcgnggtcacgccgaacgcccaaccctcgttcgtaacc

SEQ ID NO: 390275 - DNA, 608 bp, Homo sapiens
  misc_feature: GZ8MTXP01EUUAK.52.86.H09.1.454.CMB.2.raw
  modified_base (487)..(487): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatgcattcgaccaaacgatatgcttattggtaccagcagacgccggcacggccctgtgtggtgatgtataaagacactgagacggccctgagggactcccgtgacgcgtattccctcgtacgggctccgaggtaccaacggggaacaacgggtcaactagtttcgggacctagtacgagtggacgtccgaggccaggaggacgaggctaggacttagttattgtactaaatacaaacacgaacctaccgtagtttcggtaactttntcgttacgttacggaactggtaccgaaccggtaaacggttccgtaacccggtcgttacggggttccaaccggccccgaaagggccccaaaccccggcttacgtaacccgttaacttccccg

SEQ ID NO: 390276 - DNA, 556 bp, Homo sapiens
  misc_feature: GZ8MTXP01EPHBA.52.86.H09.1.454.CMB.2.raw
  modified_base (195)..(195): a, c, t, g, unknown or other
  modified_base (286)..(286): a, c, t, g, unknown or other
  modified_base (303)..(303): a, c, t, g, unknown or other
  modified_base (345)..(345): a, c, t, g, unknown or other
  modified_base (379)..(379): a, c, t, g, unknown or other
  modified_base (446)..(446): a, c, t, g, unknown or other
  modified_base (456)..(456): a, c, t, g, unknown or other
  modified_base (506)..(506): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtncagctggtggagtcgtggggggggctggtccaggctggggaggtccctgagactctcctgtgcagcctctggattcacctcagtacccatnaaatgcacgtgggtccnccgaggctccgaggcgaaggggctggaggtgggtgcagttanatcctatgatgaagacaataagcaactacgcagngtcgtgaacgggcaatgacaatctaccgagacgacaacttacgaaagtaagtcgttacgttactaanaaatagaacngacctagaacgagcgtaggacgaacgaacggtcttagttgttttaacggngtagacggaggaacggtaactagtaactacgcgactaaccgaaccgtaag

SEQ ID NO: 390277 - DNA, 384 bp, Homo sapiens
  misc_feature: GZ8MTXP01CCRVP.52.86.H09.1.454.CMB.2.raw
  modified_base (287)..(287): a, c, t, g, unknown or other
  modified_base (356)..(356): a, c, t, g, unknown or other
  modified_base (358)..(384): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagagccggcaggcccctgtgttgngatgtataaagacactgagacggccctgaggactccgtgacggccggcgtggacgaaggcgaacgatgngnnnnnnnnnnnnnnnnnnnnnnnnnnn

SEQ ID NO: 390278 - DNA, 626 bp, Homo sapiens
  misc_feature: GZ8MTXP01ED0P5.52.86.H09.1.454.CMB.2.raw
  modified_base (280)..(280): a, c, t, g, unknown or other
  modified_base (289)..(289): a, c, t, g, unknown or other
  modified_base (338)..(338): a, c, t, g, unknown or other
tcagcgcagtacgacacgaccggtgctcgatttagtgctatagacttgggtttgggggtggggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggatcacctgctctggagatgcattgaccaaacgatatgcttatggtacagcagagcggcacggcctgtgtgtnatgtataanacactagagacggtccctcgagggtactcccgtagagtcgtatttcccncgttcggctaccgaggtaccgaagggaacgtaaaccgggtcaactacgttcgggaccagttcgaaggtcggacgtccgaggcaaggacggacggaggctaggaacttatttagttacgttacgaaacttacaaacacgaacaccgtaagtttcggtaaactttagtcgttacgtttaacggactaaggaccgaaccgtaacggttaccgtaccggtcgttacgggttccaaccggaaccccgaaaacggccccaaaccccgtacggttcgtaacccgttcctttcccg

SEQ ID NO: 390279 - DNA, 530 bp, Homo sapiens
  misc_feature: GZ8MTXP01EBQMW.52.86.H09.1.454.CMB.2.raw
  modified_base (169)..(169): a, c, t, g, unknown or other
  modified_base (209)..(209): a, c, t, g, unknown or other
  modified_base (231)..(231): a, c, t, g, unknown or other
  modified_base (290)..(290): a, c, t, g, unknown or other
  modified_base (318)..(318): a, c, t, g, unknown or other
  modified_base (353)..(353): a, c, t, g, unknown or other
  modified_base (358)..(358): a, c, t, g, unknown or other
  modified_base (409)..(409): a, c, t, g, unknown or other
tcagcgcagtacgacacgaccggtgctcgatttagtgctatagacttggggtgggtccaggaggcagaactctgggtgtctcaccatggcctggatccctctacttctccccctctcactctctgcacaggctctgagcctctatgagctgacacacgccaccctggtntcagtcgtcccaggacagacgcagatcacctgctgtgganatgactattcgaccaaaacgtntagtgtacttagtcgacagacgagacggccggacgcgtccgtgtgtgatagtagtaaanaagacagagacgacgctagacgtctcgngacgcgtctcgtcgtcgcgacgagtacgaacgacncgtanacgtagtcgacagtcgagtgagcgagagagagagagatagtatatatatanacgtacaacacactactagttagttacgttatcgtcgtacgtacgtcgaacgtacgacgtacgttacgtcgtcgttacgccgaccgaaccgaccgaaccactcgttactccgttccgtccg

SEQ ID NO: 390280 - DNA, 647 bp, Homo sapiens
  misc_feature: GZ8MTXP01D9F2Q.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttagttggtaccagcaggaacgccggccacggcccctgtgttggtgatagtaataaagacactaggagacggccctagagggactcccgtgacgcgtattccgtcgtggcctcgaggtacgaagggaactaaacgggtcaacgtagttcgggaccagtcgaaggtcggacgtccgaggcgaaggaacggacgagggtctagacttaattattcgtacaactacaaacgacgaactaacctagtttaggtaactttagttcgttacgttacggaactcggaccgttaaccgtaaacggttccgaacccggttccggttacggggttccaaccggaaccccgtaaaaccgggccccctaaaaccccggtcttaccggttaacccgttaaccgttttccccg

SEQ ID NO: 390281 - DNA, 598 bp, Homo sapiens
  misc_feature: GZ8MTXP01BUUVA.52.86.H09.1.454.CMB.2.raw
  modified_base (575)..(575): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgatatgcttattggtaccagcagaagccgggccaggcccctgtgttggtgatgtataaagacactgaagacggcccctacgacgggggaactccccgtaggaacgcggtaatttccccgtcgtcgggcctcccgagggttaaccaaggggtaacgaaacgggtcaactacgttcgggacccatcgagtggagtccgaggcaggaggacgagctgacttatattgacgaatcaaacagaccaccagtttggtaacttatgttccgtcggtaactcgggcttaaccgaaggttcaacccggtcttacggggttcaacgccccgaacggtcccaaaccccncgttaccgtccaaccgtttcccg

SEQ ID NO: 390282 - DNA, 649 bp, Homo sapiens
  misc_feature: GZ8MTXP01ET5H6.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaacgatatgtcttattggtaccagcagaagccggccaggcccctgtgttggtgatgtaataaagacactgagacggccctacgagggactcccgtgacgcgtatttccctcgtggcctccgaggtacgaacgggaacaaacgggtcaacgtagtttcgggacctagttaccgaggtggacgtccgaggacaggaagggacgaggcgtagacttaattagttcgacgtaaatcaaacgaggaaccaaccgtagtttacggtaacctttagttcgttacctttaccgggaaacttcggaacccgttaaacgtaaacggttaccgaacccggtttccgttacgggggttccaaccggaaccccgaaacgggaaccccttaaacccccgacgttccgttaacccgttaacctttccccg

SEQ ID NO: 390283 - DNA, 683 bp, Homo sapiens
  misc_feature: GZ8MTXP01D8S0M.52.86.H09.1.454.CMB.2.raw
  modified_base (346)..(346): a, c, t, g, unknown or other
tcagcgcagtacgacacgaccggtgctcgatttagtgctatagacttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctggagatgcattcgaccaaacgatatgtacttatggtaccagacagaacgccgggccacggccctgtgttggtgatagtaataaagacacgtgagacggccctagagggactcccgtgagcgattccncgtggctccgaggtacaacggggaacaacgggtcaactagttcggaccagttcgaaggttggacgtccgaggacaagggacggacgagggctagtaacttagttagttacgtacgaaattacaaacgtaacggaacctaacccgtaagttttacgggttaaaccttttagtacgtttaccgtttaaccgggaaacttaacggacccgaaaccggtaaacggttcccgtaaaccccgggttcccgttacgggggttccaaacccgggaacccccgtaaaacgggtccccccaaaaaccccggtccttacggttaaccccgttaacccgttttcccccg

SEQ ID NO: 390284 - DNA, 656 bp, Homo sapiens
  misc_feature: GZ8MTXP01DL1ZG.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgacccaaaaccgtatatgtcttattggtaccagcagaagccggccaggccctgtgttggtgatgtaataaagacacgtagagacggccctagagggactcccgtagacgcgtatttccctcgtggtcctaccgaggtaccgaagggaaccaacgggtcaacgtagttcgggacctaatccgaggttcggaacgtccgaaggcgaagggaacgggacgagggccttaggacctttaagttattaggtacgaaattaccaaacgacgtaacctaaccgtaatttacggttaacctttaagtgttaccgttaacggaacttggaacccgaacgtaaacggttcccgtaaccggtccgttacgggttaccacggaaccccgaaacggaaccccaaaccccgtacgttacgtaaccttaacccgtttcccg

SEQ ID NO: 390285 - DNA, 664 bp, Homo sapiens
  misc_feature: GZ8MTXP01ETEYK.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtggttggtgatgtaataaagacactgaagacggccctcgagggactcccgtgacgcgtatttccctctggtcctccgacgggtaccgaacggggaaccgtaaacgggtaccactagttcgggccagtcaggtggagtccgaggcaaggacggacgaggactggaacttattagttgtacgaaattacaaacacgaacctaaccgtagtttacgggttaacctttagttcgttaccgttacgggtaaactcggtaacccgttaaacccgtaaacgggttcccgaaacccggttcccggttagggttacccgaacccggaacccccgtaaaaccgggaaccccctaaaacccccgtaccgttccggttaaccgttaaccctttccccgg

SEQ ID NO: 390286 - DNA, 631 bp, Homo sapiens
  misc_feature: GZ8MTXP01EQEN8.52.86.H09.1.454.CMB.2.raw
  modified_base (303)..(303): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcacctcagtacccatgaaatgcacgtgggtcccnccaggctccaggcaagggggctgggagtgggtggcagttatatcccctagtgagtggaagtacaaataagcactacgcaagtagtccgtagaacgggccgattcgacatcgtacccgagacggaaccaacgtacgaaagtaagttaaccgggtttacttacttaaacaaaagttacgaaacgaggtaccctagaaggacggacgtaggaagggaccgaacgggtcttaaagttcgggtttttaaactggttggttaccggaggggaacggggtaaaaccctcgggttaaatttaaccgaaggttaccgaacggttcccccgtaaaggg

SEQ ID NO: 390287 - DNA, 630 bp, Homo sapiens
  misc_feature: GZ8MTXP01BU5GZ.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctggagatgcattgacccaaacgatatgtacttagttggtaccagcagaacggccggccacggccctgtgttggtgtatagtaataaagacacgtgagacggccctgagggtactcccgtgacgtcgtatttcccgtcgtggcctccgaggtaccgaagggaacaacgggtccaacgtagttcggacctaagtccgaggtggacgtccgaggcgaggacggacgaggctagactattagttgacaatcgaaacagtacacctagtttacgtaactttacgtgttaccttacggaacttcggaccgttaaccgtaacggttacccgtaaccggttccgttacggggttcccaaccggaaccccgaaaccggtccccaaaccccgtagttcccgtaaccttaaccgtttccccg

SEQ ID NO: 390288 - DNA, 707 bp, Homo sapiens
  misc_feature: GZ8MTXP01BTZF9.52.86.H09.1.454.CMB.2.raw
  modified_base (239)..(239): a, c, t, g, unknown or other
  modified_base (255)..(255): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagcttacacagccaccctcggtgtcagtgtccccaggacagacggccaggatcacctgctctggagatgcattgaccaaacgntatgcttatggtaccngcagaagcggcacggccctgtgtggtgatgaataaagacactgagacggcctgagggactcccgtgagcgtattctcgcggctcgaggtcgaaacgggaacaacgggtcaacgtacgttcggacccaatcgaaggttcggacgtaccgagggacgaagggaacgggaacggaacgggtccttagggaaactttaagttaacgtttaggtaacccgtaaagttaccaaaacgtaaccggaaacctaacccgttaaaggtttacgggttaacctttaaagttcggttacccgttttacgggaaaccgtttggaacccggtaacccgttaaagggttacccgttaaccccggttacccggttcggggttaacccgacggttaacccccgaacggggaccccctaaaaccccggtccttaccgggttacctaacccggttcccgttttccccccgg

SEQ ID NO: 390289 - DNA, 676 bp, Homo sapiens
  misc_feature: GZ8MTXP01AJV6W.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaacgccgggccacggccctgtgttggtgatagtaataaagacacgtggaggacggcccctacgaagggactccccgtggacgtcggtactttccccgtcgtacggccttacccgaggtaccgaaggggtaaccaaacgggtcactagttcggacctatcgagttgggacgtccgagggcaagggacgggacgagggctaggaacttagttagttacgtactaaacttacgaaaccacggaacctaacccgtagtttacggttaacctttaagttcggttaccgtttaaccgggaacttcgggtaacccgaaaccgttaaacgggttccgtaaacccgggttcccgttaggggttccaaccgaaccccgaacggaaccccaaaccccgtattaccgtaaccgttaacgttccccg

SEQ ID NO: 390290 - DNA, 571 bp, Homo sapiens
  misc_feature: GZ8MTXP01C84A5.52.86.H09.1.454.CMB.2.raw
  modified_base (240)..(240): a, c, t, g, unknown or other
  modified_base (472)..(472): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttattggtacagcagaagccggcaggccctgtgtggtgatagtataaagacactgagacggccctacgagggactcccgtgacgcgatttcctcgtggcctccgaggtacgaagggaacaacgggtcacgtagttcggacagtacaggtggacgtcgagggcaggaaggacgaggctagactattattgtactaaatacaacagacaccgtagttaggttaaccttntagttcttacggactgtaccgacgtaaggttccgaacccggtccgttgggttccacgcccgaaacggccccaaccccgcgttacgtccgaactttcccg

SEQ ID NO: 390291 - DNA, 671 bp, Homo sapiens
  misc_feature: GZ8MTXP01BHM0J.52.86.H09.1.454.CMB.2.raw
  modified_base (223)..(223): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgcattcgacccaaaccgatatgtcttagttcggtaccagcaagaacggcccgggccgacggtccccgtgtggttggtgtatagtaataaagacacgtagagacgcccgtagagggtactcccgtagacgcgtacttcccgtcgtcggtcctccgtacggtaccgaagggaaccgtaaaccggtccaacgttagttcgggaccagttaccgtaggtaggtacgtacccgagggaccgaagggaacgggacggacggtcgtacggtaacttagtttagttacggtaacgtaaacttacgaaacctaacgaacctaccgtagtttacggttaactttagttcgttacgttacggaacgtcgaccgaacgtaacggttccgtacccggttcgttacggttccaccgaacccgacggaaccccacccgtacttcgtaaccttccgttcccg

SEQ ID NO: 390292 - DNA, 810 bp, Homo sapiens
  misc_feature: GZ8MTXP01C2LR5.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttattcggtacagacagaagccgggcacggccctgtgttggtgatagtaataaagacactagagacggccctgagggactcccgtgacgtcgtactttccgtcgtcgggtcctccgaacgggttaccgaacggggaaccgtaaaccgggttccaaacgtaacgtttcgggacccctaaagttcgaaacgggttgggaaacggttcccgaaggggaccgaaagggggaaacggggtaaccgggaaggggtaccgttaacgggtaaacgtttaaattttaaacgtttacggtaaccgttaaaacttaacccggtaaaaacctacggaaaacccgtaaacccttaagtttacggggtttaaacccttttaagttccggttaccggtttaaccgggaaacgtttaacggacccggttaaaccccggtaaagggttcccggtaaaaccccgggtttcccggttaaacggggggttaccccttaaaccggggtaaccccccgtaaaaaccgggggtcccccaaaaaccccccttaacggttccggttaacccgttaacccttttaacccccgg

SEQ ID NO: 390293 - DNA, 562 bp, Homo sapiens
  misc_feature: GZ8MTXP01C8KXD.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgntatgcttatggtacagcagaagccggcaggcccctgtgttggtgatgtataaagacactagagaggccctcgagggactccctagacgcgtattcctctggctccgaggtacagggcaacggtcacagttcggccatcagtggagtccgaggcaggaggacgaggctagacttattattgtacaatcaaacagaactacctagttaggtaactttgtcgttctacgggtaacttggacgaacctaaacgggttcctaaccgtccgttacggggttccaacggccccaaaggccccaaaccccgcgttacgtccaactttcccg

SEQ ID NO: 390294 - DNA, 643 bp, Homo sapiens
  misc_feature: GZ8MTXP01DXGU8.52.86.H09.1.454.CMB.2.raw
  modified_base (292)..(292): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacaggacggccaggatcacctgctctggagatgcattgaccaaaccgatatgtcttattggtaccagcagaagccgggccaggcccctgtcgtttggngatgtaaataaagacactaggagaggcccctgaaggggactccctggaacgcgtatttccctcgtaggcctaccgagggtcaacggggcaaaccgggtcaactaagttcgggacctagtcagggttggacgtccgaggacaagggacgggaccgaaggtccgtgtaacgttattaacttgtactaaattcaaacacgaacaacctaagtttcggtttaaacttatggttaccttacggaaacttcgtccgaaaccgtaaggggttcctaaaccccggtcgttacgggggttccacgggaacccctaaacgggcccctaaaaccccctcgttaccgtccttaaccgttcccg

SEQ ID NO: 390295 - DNA, 664 bp, Homo sapiens
  misc_feature: GZ8MTXP01D7Q8X.52.86.H09.1.454.CMB.2.raw
  modified_base (223)..(223): a, c, t, g, unknown or other
  modified_base (360)..(360): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgatatgtcttagttggtaccagcagaacgccgggcacggccctggtgttggtgatagtaataaagacacgtaggaaggacggcccctacgaaggggtactcccgtagacgcgtactttcccncgtaggcctaccgaggtaaccgaagggaaccgaacgggtcaacgtagttcgggaccctagtccgaggtaggacgtaccgaagggacaagggaaggaccggaggtctagaacttattattcgactaaatacaaacacgaaccaccgtagtttacggtaactttaagtgtttaccgttacggaacgttcggacgttaaaccgtaacggttccgaacccggttccgttcggggttaccaacccgggaacccgaaaccgggaacccctaaaccccgtacggttaccgtaacccgttaacctttccccg

SEQ ID NO: 390296 - DNA, 597 bp, Homo sapiens
  misc_feature: GZ8MTXP01DE3F7.52.86.H09.1.454.CMB.2.raw
tcagcgcagtacgacacgaccggtgctcgatttagtgctatagacttgggtttgggcacgaccggtgctcgatttagtgctatagacttgggtttgggggctgtgggtccaggaggcagaactctgggtgtctcaccatggcctggatccctctacttctccccctcctcactctctgcacaggctctgacggcctcctatgagctgacacacgccaccctcggtgtcagtcgtccccaggacagacggccaggactcacctgctctaggagatgcattacgaccaaaccgtatatgtacttagtggtaccagcaggacgcccgggcccacggtcccctggttgttggtagataggtaataaagacacgtgaacgacggtcccgtacgacggggactcccgtagacgcggtacttcgtctcgggctcgaggtcgaacgggactaacggtcacgagttcggctagtcggaggttggacgtaccgaggcgaggacggaaacggcgtacgtagtacttagttaatacgttactaacttacgaacgtaacgttacgcttagttaacgtacgttaagtacgttcgacgtaacgcggtaaccg

SEQ ID NO: 390297 - DNA, 594 bp, Homo sapiens
  misc_feature: GZ8MTXP01DC9O4.52.86.H09.1.454.CMB.2.raw
  modified_base (298)..(298): a, c, t, g, unknown or other
  modified_base (301)..(301): a, c, t, g, unknown or other
  modified_base (305)..(305): a, c, t, g, unknown or other
  modified_base (312)..(312): a, c, t, g, unknown or other
  modified_base (338)..(338): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacacgccacccgtggtgtcagtcgtaccccgaggacagacgccaggactcacctgctcgtaggatatgactattcgaaccaaacgattatgtcttagttaggaccagcaagacgccggcacggcctgtgtgnatntaanaagcagngagacgcctagaggtactccgtgacnccgtattctacgcgtcctacgagtcgagggacaacggtcacgtgtcgacatcgaggtgacgacgaggaccgaggaacggcgaacgcgtaagtacttagtttaactcgtaacaactacgaaacaacgtactaaccgttagtttacggtaacttagtcggttacttaaccggtaacttcggaccaaacgttaaccgggtcttacccggttcgacggtaacccacgtaacccaaccggacccaccgtaacttcgtaacc

SEQ ID NO: 390298 - DNA, 645 bp, Homo sapiens
  misc_feature: GZ8MTXP01DY9LV.52.86.H09.1.454.CMB.2.raw
  modified_base (303)..(303): a, c, t, g, unknown or other
  modified_base (492)..(492): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggcgtggtccaggctgggaggtccctgagactctcctgtgcagcctctggattcacctcagtacccatagaaatgcactgggtcccnccaggctcccgaggcgaagggggctgggagtggggtgctaggttatactccctatgatggaagaacaataagcaacgtacgacagagtccggtaggaacgggtcctattcgaccctagtcctaccgaagacgaacaacgtacgaaagtaaacgttaccggtttacttaactaaacaaattacggaaacncgtaccgttaggaaacggagtaccgtaggaacgggtaaccgaaacgggtttctttaacggtttacggttttacggtagggtaacgggaacggttaagggttaacgggtaactaggtaacgttaccgacgttaccgtaaccgttaacccgtaag

SEQ ID NO: 390299 - DNA, 686 bp, Homo sapiens
  misc_feature: GZ8MTXP01B111B.52.86.H09.1.454.CMB.2.raw
  modified_base (223)..(223): a, c, t, g, unknown or other
  modified_base (289)..(289): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgganatgcattgaccaaaccgatatgtcttattcggtaccagcaagaagccggccacggccctgtgtgtnatgataagcacgtgagacggcctcgagggactcccgtgagcgattccctcgtggcctccgaggtacgaagggaacaaacgggtcaacgtagttgggacatcgaggtgggacgtaccgagggacgaagggacggacggacgtcgtaggtaactttagttagttcgtaaacgtaaactaaccaaacgtaacggaaacctaaccgttaggtttaaccggtttaatttacgtacgtttaccggtaacgggtaaccttaacggaaaccccggttaaaccggtaaccgttacccggttaaacccggttccgggttaacgggttcccgaaccccggtaacccggaacccggtaaccccctaaaaccccgtcgttacccggtaaccttaacccggtttaaccccg

SEQ ID NO: 390300 - DNA, 703 bp, Homo sapiens
  misc_feature: GZ8MTXP01BNJ9O.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggccctgtcgttggtgatgtaataaagacacgtagagacggccctacgagggtactcccgtgaacgcgtaatttccctcgtggcctaccgagggtaccgaaggggtaaccgaaacgggtccaacctacgttcggggaccctagttaccgaggttcggacgtacccgagggaccgaaggacgggaaccggagggcttacggtaactatttaagtttacggtactaaagttaccaaacaacggaacctaaccctagtttaagggttaacctttatacggttactttaccggggaaactgggtaacccgaaaccgttaacgggttacccgtaaacccggtttcccgttcgggggttacacccgggaacccccgaaaaccggggttaaccccaaaacccccgggtaacgttccgtaacccgttaaccgtttcccccg

SEQ ID NO: 390301 - DNA, 738 bp, Homo sapiens
  misc_feature: GZ8MTXP01CCOUV.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtgagtcgtcccccaggacagacggccaggatcacctgctctggagatgcattcgaccaaaccgatatgtcttattggtaccagcagaagccggcacggcccctgtgttggtgatgtaataaagacacgtgagacggccctcgagggactcccgtgagcgtattccgtctggcctccgaggtaccgaaggggaacaacgggttccaacgagtttcgggaccctattaccgtagtttgggaacgttacccgagggaccgaagggaacggggaccgaagggcgttaggtaaacctttaagtttagtttacggttaacgtaaactttaccaaaacgacggtaaacctaaccccgttaagtttacgggttaaaccttttagttcgtttaccgttttaaccgggaaacttcgggaaccgttaaccgggtaaaccgggttccccgtaaaccccggtttcccggttacgggggttacccgaacccggtaacccccggtaaaccggggaaccccccgtaaaaccccctacggttaccggttaaccccgttaacccttttccccccggg

SEQ ID NO: 390302 - DNA, 592 bp, Homo sapiens
  misc_feature: GZ8MTXP01EOWIP.52.86.H09.1.454.CMB.2.raw
  modified_base (219)..(219): a, c, t, g, unknown or other
  modified_base (235)..(235): a, c, t, g, unknown or other
  modified_base (410)..(410): a, c, t, g, unknown or other
tcagcgcagtacgacacgaccggtgctcgatttagtgctatagacttgggtttgggggtgggtccaggaggcagaactctgggtgtctcaccatggcctggatcccctacttctcccctcctcactctctgcacaggctctgaggcctcctatgagctgacacagccacctcggtgtcagtgtccccaggacagacggccaggatcacctgctctgganatgcattgccaaacgntatgcttatggtaccagcagaagccggcaggccctgtgtgtgatgtataaagacactgagaggccctgagggatcctgagcgattctcctggctcgaggtcaagggacaacggtcacgattcggcctatcgaagtggagtccgaggcagaggacgaggctaggacttatatgtanaacgtcaaagtacgactaaccgtattcgggttactttaagtcgttacgtttacgggaaacttcggaaccgtaaccttaaacggggtccttaaacccggttcccgtagggggttacccacggaccccgaaagggacccctaaaccccgaacgttcggttactaacccgttcgtttaaccccgg

SEQ ID NO: 390303 - DNA, 563 bp, Homo sapiens
  misc_feature: GZ8MTXP01EH2CI.52.86.H09.1.454.CMB.2.raw
  modified_base (462)..(462): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttatggtaccagcagagccggcaggccctgtgtggtgatgtataaagacactggagacggccctagagggactcccgtggacgtcccgatttcgtcgtcggcctacccgagggtcgaagggaccaaacgggtcactagttcggaccctagtcgagtgggacgtccgaagggcaaggaggacgaggctagaacttattattgtacaaatcaaanagacactaattggtaacttatgtcgtaacgaattgcgttaaccgaggtcacccgttcgttcgggtcacgcccgaacggcccaaacccctcgttcgtaaccc

SEQ ID NO: 390304 - DNA, 505 bp, Homo sapiens
  misc_feature: GZ8MTXP01C5FQY.52.86.H09.1.454.CMB.2.raw
  modified_base (238)..(238): a, c, t, g, unknown or other
  modified_base (392)..(392): a, c, t, g, unknown or other
  modified_base (496)..(496): a, c, t, g, unknown or other
  modified_base (502)..(502): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaacgntatgctatgtacagcagagcggcagccctgtgtggtgatgtataaagacactgagacggccctcgagggactcccgtgagcgatttcctctggctccaggtcagggcaacggtcacattggcatcagtggagtccaggcaaggaggacgaggcnggactattaattgtacaaatcaaacagacaacctagtttggtaacttatgtcttcggaactgcgacaaggttcacgtcttgggttcacggccaaggccaacccnttctcnctc

SEQ ID NO: 390305 - DNA, 604 bp, Homo sapiens
  misc_feature: GZ8MTXP01AXKYW.52.86.H09.1.454.CMB.2.raw
  modified_base (242)..(242): a, c, t, g, unknown or other
  modified_base (338)..(338): a, c, t, g, unknown or other
  modified_base (584)..(584): a, c, t, g, unknown or other
  modified_base (595)..(595): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctggagatgcattgaccaaacgntatgcttattggtaccagcagaacgccgggcacggccctgtgtggtgatgtataaagacactgagacggccctcgagggactcccgtagagacgtnttccgtcgtcggctccgtaggtaacgacgggaaccgtacggtacaacgtgttcggacctagtccgtaggtaggtacgacggacggagaagggacggacggagtcgtacgattaagtttagttacgacgtaactacaaacgacgaactaccgtagttacggttaacttagtcgttacgtacgtacgtcgaccgttacgacgttaccgacccgttcggcgcaccgaacccggaacgccccaacccgtnttccgtaaccncgtttcccg

SEQ ID NO: 390306 - DNA, 588 bp, Homo sapiens
  misc_feature: GZ8MTXP01CZ52X.52.86.H09.1.454.CMB.2.raw
  modified_base (259)..(259): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctggagatgcattgaccaaacgatatgcttattggtaccngcagaagccgggcaggccctgtgttggtgatagtataaagcactgagaggccctgagggactccctgacgcgattcctctggctccgaggtaccgagggcaacggtcacgattcgggaccagtcaggtggacgtccgagggcaggaggacgaggctgactatttaattcgtacaacgtacaaacacgaactaaccagtttaggtacctttatggtttaccttcgggaaacttggacgttaccgtaaacggttcccgtaacccggtcttcgggggttccaacggccccgaaacgggccccaaaacccccgcttcgtccgaacctttcccg

SEQ ID NO: 390307 - DNA, 658 bp, Homo sapiens
  misc_feature: GZ8MTXP01BFLZI.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgtcttatggtaccagcagaagccggccacggccctgtgtggtgatgtaataaagacactgagacggccctgagggactccctaggagcgtatttcctcgtggctccgacggtcaaggggtaaccaacgggtcacgtagttcgggaccctaagttccgaaggttcggacgtacccgagggaccgaagggaacgggacggaacggtccgtaggtaaccgttaatttagttacggtacgtaaattaccaaaaccgagtaaacccaaccctagttacgggtttaaacttagttcgttaccgttacggaaacttcggacccgttaaaccgtaaacgggttccaacccggttccgttcgggttccaaccggccccgaaacggccccaaacccctgttaccggtccttaacccgtttcccg

SEQ ID NO: 390308 - DNA, 535 bp, Homo sapiens
  misc_feature: GZ8MTXP01E1MXF.52.86.H09.1.454.CMB.2.raw
  modified_base (239)..(239): a, c, t, g, unknown or other
  modified_base (487)..(487): a, c, t, g, unknown or other
  modified_base (518)..(518): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtacagcagagcggcaggccctgtgtggtgatgtataaagacactgagacggccctcgagggactcccgtgagcgatttccctctggcctccgaggtcaggggaacaacggtcacattggccatcagtggagtccgaggcagacggacggagcgtgacttagttatgtacaatcaacagaccacctattaggtacttagtgttcgtcggaactgcgaaccaagggttccaccggtccngggttccagccccgaacggccccaaaccccncttcgtccaacttcccg

SEQ ID NO: 390309 - DNA, 690 bp, Homo sapiens
  misc_feature: GZ8MTXP01DFKI7.52.86.H09.1.454.CMB.2.raw
  modified_base (497)..(497): a, c, t, g, unknown or other
tcagcgcagtacgacacgaccggtgctcgatttagtgctatagacttgggtttgggggtgggtccaggaggcagaactctgggtgtctcaccatggcctggatccctctacttcctcccctcctcactctctgcacaggctctgaggcctcctatgagctgacacagtcaccctcggtgtcagtcgtccccaggacagacggccaggatcactgctcgtggagatgctattcgaacccaaaacgtatatgtactttagttcggtaccagacgaagaacggcccgggaccacggcccctggtcgttggtagatagtaaataaagacacgtgagacggccctgaaggactccgtagacgtcgtattccctacgtcggcttacgaggtacgaagggaacgaaacggtcaacgtagttcggactatcgagtggacgccgaggacaaggaacggacggagtccgtagaacttaattagttacgtaacgaaacgttacaaaanaacggaacctaaaccgttagtttacgggttaaacctttagttacggttaccgttaaccggtaaacgttcggaacccgttaaacggtaaacggttccggtaaaccccgttccgggttacgggttaccaaccggtaaccccgaaacggtaaccccctaaaccccgtattaccggtaaccttaacccgtttccccg

SEQ ID NO: 390310 - DNA, 596 bp, Homo sapiens
  misc_feature: GZ8MTXP01BQOVC.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctcgagggactccctgagcgtattcctcgtggcctccgaggtcagggcaacgggtcacattcgggcatcagtggagtccgaggcaggaggacgaggctgacttattagttgacgtaaatcgaaactagaccaccctagtttacggtaactttatggttaccttacgggaactggaccgaaccgtaacgggttccgtaacccggttccgttacgggggttccaaccggccccgaaacgggccccctaaacccccgtacgttcggttaacccgttaactttccccg

SEQ ID NO: 390311 - DNA, 695 bp, Homo sapiens
  misc_feature: GZ8MTXP01AFXPB.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttatgtaccagcagacgccggccacggccctgtgttggtgatagtaataaagacacgtgacgacggtccctagagggtactcccgtagacgtcgtatttcccgtcgtcggccttacccggaggtaccgaacgggtaacctaaacgggtccaacgtacgttcggacctattacggaggttcgggagtacccgagggaccgagggtaacggggaccgtagggtcgttacggtaactttaagtttagttacggttaaacgaaacttaccgaaaaccgttaaccgaaaccgaccttaaggtttacggtttaaccttagttcgttaccgttacggaacttaacggaccgttaaccgtaaacggttcccgtaaaccggttcgttcgggttccaccgaaccccggaacggaacccctaaaccccgtcgttaccggtaacccgttaaccgtttccccg

SEQ ID NO: 390312 - DNA, 634 bp, Homo sapiens
  misc_feature: GZ8MTXP01DF8CX.52.86.H09.1.454.CMB.2.raw
  modified_base (239)..(239): a, c, t, g, unknown or other
  modified_base (254)..(254): a, c, t, g, unknown or other
  modified_base (278)..(278): a, c, t, g, unknown or other
  modified_base (328)..(328): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgaccaaacgntatgcttatggtacngcagagcggcaggccctgtgtgtnatgtataagacactgagaggccctgagggactccctgacgcgatttcccnctggcctccgaggtccaagggaacaacgggtcaacgtatttcgggacctaattccgaaggttggacgtaccgagggccaaggagggacgaaggtctaggaacttagttaagttcgtacgaaacttcaaacgacgtaaccaaccctagtttacggttaacctttagtcgtttaccgttacgggaacttcggtaccgaaaccgtaaacgggttcccgtaaacccggttccgttacgggggttccaaccggaacccccgtaaaacgggccccaaacccccgtacgttacgttcccgaaccgtttccccg

SEQ ID NO: 390313 - DNA, 617 bp, Homo sapiens
  misc_feature: GZ8MTXP01BZGPT.52.86.H09.1.454.CMB.2.raw
  modified_base (301)..(301): a, c, t, g, unknown or other
  modified_base (361)..(361): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggctggtccaggctggggagtccctgagactctcctgtgcagcctctggattcacctcagtacccatgaaatgcacgtgggtccnccaggctccgaggcgaaggggctgggagtgggtgctagttatatcccctatgatgggaanacaataagcaacgtacgcaggacggtcgtaggaacgggccgtagttacgacctatccgtacccgagacgaacaaacgtacgaaagtaacgttaccggtttacttacgtaaaccgtaaagttacggaaactacggacccttaggaagacgcgtagggacggtaccgaacgggtcctttagttcgttttaacgtggtaggaccggaggttacgggtaacgtcgtaacgttacgacgttaccgtaacgccccgtaacgg

SEQ ID NO: 390314 - DNA, 705 bp, Homo sapiens
  misc_feature: GZ8MTXP01CWF91.52.86.H09.1.454.CMB.2.raw
  modified_base (237)..(237): a, c, t, g, unknown or other
  modified_base (280)..(280): a, c, t, g, unknown or other
  modified_base (289)..(289): a, c, t, g, unknown or other
tcagcgcagtacgacacgaccggtgctcgatttagtgctatagacttggggtgggtccaggaggcagaactctgggtgtctcaccatggcctggatccctctacttcctccccctcctcactctctgcacaggctctgaggcctcctatgagctgacacagcccaccctcggtgtcagtcgcccaggacagacggccaggatcacctgctcgtggagatgctattcgaccaaacgtntatgtcttatggtacagcagaagccggcacggccctgtgttgngatgtaaanaaagacactgagacggccctacgagggtactccgtgacgcgtattcctccgtacggtctccgtacgggtaccgaaacggggaacctaacgggtacaaacgtacgtttcgggacctagtacgaggttagggacgtaccggagggacgaaggaacggggaacggacgggtaccgttaggtaaccttaaagtttagtttaacggttaacccaaagtttaacccgaaaactaaacggaacccttaaacgtacgtttacggtttacctttaaagttcgtttaccgttaacggtaacgttcggaaccgtaaaccgttaaggggtacccttacccggttaccggtcgggttacccgaccgaccccgaaaccgggaaccccaacccgtaccgtcggttaccctaaccttccggtttaacccccg

SEQ ID NO: 390315 - DNA, 565 bp, Homo sapiens
  misc_feature: GZ8MTXP01AYH8K.52.86.H09.1.454.CMB.2.raw
  modified_base (242)..(242): a, c, t, g, unknown or other
  modified_base (286)..(286): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggngatgtaataaagacactagagacggccctcgagggactcccgtggacgcccggtattcgtcgtcgggccttacccgagggtcaagggggaccaacgggtcaactagttcggaccagtcgaggtcggacgtccaggcaggaggacgaggctagattattagtcgtacatacaacagacacctattggtaccttagtcgtcttaacggaacttgacgacgtaagggtccacccgttcgacgggtccacgcccaacgggccccaaccctaacggttctcccg

SEQ ID NO: 390316 - DNA, 635 bp, Homo sapiens
  misc_feature: GZ8MTXP01A6L80.52.86.H09.1.454.CMB.2.raw
  modified_base (225)..(225): a, c, t, g, unknown or other
  modified_base (242)..(242): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgctatgaccaaacgntatgcttattggtaccagcagaacgccggcaggcccctgtgttggtgatgtaataaagacactgagacggccctcgagggactcccgtgacgccgtattcgtcgtcggtcctaccgaggtcgaacgggacaacggtcactagttgacccatcgagtgggacgtccgaggcgaggacgggaacggaggaccgtagtaacgttaagtttaagtttacggtactaaacttacgaaactaggaaacctaccctaagtttaggttaacttacgttacgttcgttaacgggaaacgttcggaccgttaaccgtaaacgggtcccttaacccggttcgttacgggtaaccgaccggtaacccgaacgggaccccaaccccgtaacgttcggttaaccccg

SEQ ID NO: 390317 - DNA, 676 bp, Homo sapiens
  misc_feature: GZ8MTXP01D9MZ5.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctcgtggagatgcattcgacccaaaccgatatcgtcttattggtaccagacagaacgccgggccacggcccctggtgttggtgatagtaataaagacacgtgaagacggccctcgagggactcccgtggacgcgtactttcccgtcgtcggtcctccgaacgggttaccgaacggggaacgtaaacgggtaccaaacgtagtttcgggacctatcgacggtgggacgtccgagggcaaggacggacggaggctagacttaatttagttcgtactaaacttaccaaaacgtacgaaccctaaaccgttaagttttacgggttaaaccttttaagttcgttaccgtttaccggaaacgttcggaaccgaaacgtaacggttccgtaacccggttccgttgggttacccacggaaccccgaaaccggaaccccaaccccgacttcgttccaacctttccccg

SEQ ID NO: 390318 - DNA, 563 bp, Homo sapiens
  misc_feature: GZ8MTXP01A6LXP.52.86.H09.1.454.CMB.2.raw
  modified_base (234)..(234): a, c, t, g, unknown or other
  modified_base (534)..(534): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttatgtacagcagagcggcacgccctgtgtgtgatgtaataaagacacgtgagacgccctcgagggtactccgtgacgcgattctccgtggctccgaggtcgaagggaacctaacgggtcaacgtagttcggacctagtcgtaggtggacgtccgagggcaggaggacggaggtctagacttattattgtacaatacaaacagacactagttcgttaacttagtcgtcgttacgaactgaaccgaacgttaggtccaccgtcgtcgggttaccacgacccgaacgccccaacccncgtcgttcctaaccgttccgttaaccccg

SEQ ID NO: 390319 - DNA, 624 bp, Homo sapiens
  misc_feature: GZ8MTXP01DWOWV.52.86.H09.1.454.CMB.2.raw
  modified_base (295)..(295): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaacgatatgtcttattggtaccagcagaacgccgggccacggcccctgtgttggngatgtaataaagacactgagacggccctcgagggactcccgtgacgtccgtattctcgtggcctaccgaggtcgagggacaacggtcactagttcggccagtcgaggtgggacgtccgagggacgaagggaggaccggaggctaggacttagtttagttagtacaaattacaaacaacgacaccgttaagttcggttaaccttagttcgttaccgttaacggtaacttcggtaaccgaaccgtaaacggtcccaaccggttccgttacggggtaaccacggaaccccgaaacgggaccccttaaaccccgtcgttaaccggttaacccc

SEQ ID NO: 390320 - DNA, 668 bp, Homo sapiens
  misc_feature: GZ8MTXP01AI3MU.52.86.H09.1.454.CMB.2.raw
  modified_base (657)..(657): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacacgccaccctcggtgtcagtcgtccccaggacagacggccaggatcacctgctcgtggagatgcattcgaccaaacgatatgtacttagttggtaccagcaggaacggcccgggccacggtccccgtggtggttggtgtatagtaaataaagacacgtgaggacggccctagagggtactcccgtgacgtcgtactttccgtcgtcggctaccgaggtaaccgaagggaaccaaacgggtcaacgtagttcggaccagtcgagtcgggacgtcgaggcgaaggacggacggaggactagactttaagttagttacgtacgtaatacgaactaacggaactaccgttaagtttacggttaactttagttccgttaccgttacgggtaaaccgttcgaaccggttaaccgtaacgggttcccgtaaccggttaccggttcggggaccaaccggtaaccccgaacgtaacccccaaacccgtccgttcgttaaccnccgtttccccg

SEQ ID NO: 390321 - DNA, 693 bp, Homo sapiens
  misc_feature: GZ8MTXP01EQ9UF.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaacgatatgtcttattggtaccagcagaagccggcacgccctgtgtggtgatgtataagacactagagacggcctcgagggactcccgtgacggcgtattccctacgtcggccgtccgacgggtaccgaagggaaccgtaaccgggtacaaccgtagttcgggaccctataccgtaggtggtacgtccgaggaccgaagggaacggacggtacggcgtaacggtaccttaagtttagttacgttaacgtaaacttaccgaaacctaacggaacctaaccgtaagtttaccgggttaactttaagtcgttacgtttaaccggaacgtcggtaaccggaacccggtaaacggttcccgtaaccccggtaccggttacgggggttacccaaccggaacccccggtaaacggtaacccccaaaccccggtacttaccggtaaccccgttaaccgtttccccg

SEQ ID NO: 390322 - DNA, 597 bp, Homo sapiens
  misc_feature: GZ8MTXP01CYAW3.52.86.H09.1.454.CMB.2.raw
  modified_base (244)..(244): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattcgaccaaaccgntatgcttatggtaccagcagaacgccggaccacggcccctgtgttggtgatgtaataaagacacgtggagacggccctcgaggactcccgtgacgccgtattctcgtcggcctaccgaggtcgagggaaccaacggtacacagttcgggacccatcgaggtcggacgtaccgaggacgaggaggacggaggtctagtaacttagttagtgtactaaatacaacacgactaccgtagttacggttacttagtcgttacgttaacggaacgttcgaccgaaccgtaaacggtccgttaacccgttcgttcgggtaacaccgccccgaacggccccaaccccgtcgttcgtaaccc

SEQ ID NO: 390323 - DNA, 688 bp, Homo sapiens
  misc_feature: GZ8MTXP01A3H9T.52.86.H09.1.454.CMB.2.raw
  modified_base (290)..(290): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgcattcgaccaaaccgatatgtacttattggtaccagcagaacgccggcacggccctgtgttggngatgtataaacgacactgagacggccctagagggtactcccgtaggagtcgtacttcccgtcgtcggacctccgaacgggttaaccgaacggggtaacccgaaacggggtctaaccgtacgtttcgggacctaacgtacgaacgggttggaaacggtacccggaaggaccggaaagggacgggaacggtaacgggccgttaaggaacctttaaggttacttaggttacaaacgtacaaacacgaacctaaccgtagttacggttaacttacgtcgttaccgtttaacggacgtaacggtacccgttaaacggtacggttacccgacccgggttcacggggttcaccggaacccgaccggaaccccaaacccctgttacctaacttaaccgtttccccg

SEQ ID NO: 390324 - DNA, 663 bp, Homo sapiens
  misc_feature: GZ8MTXP01EI88K.52.86.H09.1.454.CMB.2.raw
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggccgtcctatgagctgacacacgccaccctggtgtcagtcgtccccaggacagacggccaggatcacctgctctggagatgctattcgaccaaacgatatgtcttagttcggtacagcaagaacgccgggccacggcccctggtgttggtgtagtagtaataaagacacgtggaggaccggccctaggagggtactcccgtagacgtaccgtactttcgtcgtcggcctaaccgagggtccgaggggtaaaccgtaacggtaccaacgtacgtcgggacctagtcgagggtaggacgtaccggaaggacgaagggacgggacggaggtactagtaacgttagtttaggttacgtaactaaacttacgaaacgacgtaactaaccgttagtttacggttaactttagttacgttccgttaacggtaacttcggaccgttaaacgtaacggtccgttacccggttcgttacgggtcccacgaaccccgaacggaccccacctaacgttctaacccg

SEQ ID NO: 390325 - DNA, 741 bp, Homo sapiens
  misc_feature: GZ8MTXP01BWXPH.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcagttcgaccaaacgtatatgtacttagttcggtaaccagacgaaggaacggcccggaccgacggtcccctggttgttggtagagtacgtaaataaagacacgtaggaacgacggacccctaggacgggtactacccgtaggaacgcgtactttcccgtcgtaggccctacgaggtacgaacgggaacaaccggtacacgtattcgggaccaagttaccgaaggttcggaacggtacccgagggaaccgagggtaaaccgggacggaaggtccgtaacggtaaacttaaggttttaatttacggaaccgtaaaagttccgaaaaaccaacggttaaacccgaactttaagtttacggtttaaacctttagtcggtttaccgtaccggtaaacgtccgggaaaccgttaacccggtaaacgttccgttaaaccccggtcggttaccggggccaacccggggaaccccaacgggaacccccttaaaccccgtcgttactcccgttaaccgttcccg

SEQ ID NO: 390326 - DNA, 794 bp, Homo sapiens
  misc_feature: GZ8MTXP01EKOWZ.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacaggacggccaggatcacctgctctggagatgcattgaccaaacgatatgtcttattggtacagcagaagccggcaggccctgtgtggtgatgtataaagacacgtgagacggccctacgagggactcccgtgacgacgtactttccccgtcgtcggtcctaccgtaacgggtaacccggaacgggtaaccggtaaaccgggtacctaaaccgttacggtttaccggggaacctacgttacccggtaaggggttacggggttaaccggtaccgggaacgggaccgaaaggggtaacggggtaaccgggaagggtacccgttaggtaaacctttaagtttaacgtttacggtaaaccgtaaacttaaacccggtaaaacgaaccgtaaacctaacccgttaagttttacgggttaaaccttttaggtaccggtttaccgttaacggtaacgtccggtaaccggttaaccgtaaaccgggttcccgtaaacccgggttccgggttacgggttaccccgttaacccggaaccccggtaaacccgggtaacccccgaaccccctacgttaccccggtaaccgttaaccccgggttttcccccg

SEQ ID NO: 390327 - DNA, 842 bp, Homo sapiens
  misc_feature: GZ8MTXP01CZ2KX.52.86.H09.1.454.CMB.2.raw
  modified_base (227)..(227): a, c, t, g, unknown or other
  modified_base (245)..(245): a, c, t, g, unknown or other
tcagcgcagtacgacacgaccggtgctcgatttagtgctatagacttgggtttgggggtggggtccaggaggcagaactctgggtgtctcaccatggcctggatccctctacttcctcccctcctcactctctgcacaggctctgaggcctcctatgagctgacacagcccaccctcggtgtcagtcgtccccaggacaggacggccaggatccactgctcgtgganatgctatcgaccaaacgntatgcttattggtacagcagaacgccgggccacggccctgtgtggtgagtgtataaagacacgtgagacggccctgagggactccccgtaggacgcgtacttccgtcggtacggtcctaccggtacggttaaaccgggaacgggtaaccggtaaaccgggtacctaacggttaaggttcccggacgtaactacgggtaaacgggttcgggtaaccggtacgggaccggaagggtaacgggggaaacggggacgggtaacgggacgttaaccgttaaacgtttaacgttttaagggtttaacgtaaaccgtaaacttaaaaccccgtaaacgaaaccgggtaaacccttaccgttaaacggtttaccgggttttaaagtttacgttttaccgggttaccgtttaaaccggggtaacgtccgggtaaaacccggttaaaccgggttaaaacccggttcccgggttaacccccgggttccgggttaccgggggttaaccccttaacccggggtaaacccccggaaaccccggggttaaaccccccaaacccccggttaacgttcccccggttaaacccgttaacccttttcccccccggg

SEQ ID NO: 390328 - DNA, 579 bp, Homo sapiens
  misc_feature: GZ8MTXP01AV41X.52.86.H09.1.454.CMB.2.raw
  modified_base (161)..(161): a, c, t, g, unknown or other
  modified_base (297)..(297): a, c, t, g, unknown or other
  modified_base (336)..(336): a, c, t, g, unknown or other
  modified_base (396)..(396): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttccncgttgctcttttaagaggcgtccagtgtcaggtgcagctggtggagtctggggggggctggtccaggctgggaggtccctgagactctctgtgcagcctctggatcactcagtacccatgaaatgcactgggtccncaggctccaggcaagggggctgggagtgggtgcagttanatccctatgatggaagcaataagcactacgcagagtccgagaagggtccattgaccatcnccagagacaacaccgaagaagtaacggttacgttacttaaccaaattaggaaccagaccgagagaagtccgacgaggacgaaaccgggttacgttacgttacgtttacgtacggtacggttacggacggttacgggtaacgtacgtaacgtaacgtacgaccgtaaccgttaacccgtaaccg

SEQ ID NO: 390329 - DNA, 649 bp, Homo sapiens
  misc_feature: GZ8MTXP01BWM2U.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgaccaaacgatatgtcttattggtaccagcagaagccggcaggccctgtgttggtgatgtaataaagacactggaagacggcccctacgaagggggtacttccccgtaggacgtcgactttcctcgtcggcctcccgaggtaccgagggaacaacggtcactagttcggaccaatccgaggtgacgtcgaggcaggaggcgagctagactattattgacaaacgtcaaacacgtaaccaccgtaagttacggttactttagtcgttaccgtttacgggaaacctggaaacccgttaaccgaaacgggttacccgtaaccccggtttcgttacgggggttcccaaaccggggaaccccctaaaggggtaaccccccaaaacccccggttacgttaccgttaacccgttaaccgtttcccg

SEQ ID NO: 390330 - DNA, 728 bp, Homo sapiens
  misc_feature: GZ8MTXP01DPVUS.52.86.H09.1.454.CMB.2.raw
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgacccaaacgntatgtacttattggtaccagcagaagccgggccacggcccctgtgttggtgatagtataaagacactgaagacggccctcgagggactcccgtgacgcgtactttccctcgtcggccttcccgagggtaccgaacggggtaacaaacgggttccaaacgtacgtttacgggccctaaagttccgtaaagggttcgggaaacggttcccgaagggaccgaagggaaacgggaccgggaagggtcctagggtaaaccttaagtttaagtttacggttaacgtaaaactttccaaaaacgtacggaaacccgtaaccttagttttacgggtaaaccttttaagttccggtttacgttaccgggtaaaccgttcgaccggaaacccgtaaacggggttccctaaacccggttcgtttacgggggttcaaccgggaaccccgaaacgggcccctaaaacccccgacttccgtaaccgttaacccgtttccccg

SEQ ID NO: 390331 - DNA, 634 bp, Homo sapiens
  misc_feature: GZ8MTXP01DC7W0.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcactgctctggagatgcattcgacccaaacgntatgtacttattggtaccagcagaagccggccacggcccctgtgttggtgatagtaataaagacacgtagagacggccctacgagggactcccgtagacgcgtactttccgtcgtggccgtacccgagggtaaccgaaggggaaccgtaaacgggtaccaacgtagttcggaccagtcgaggttggacgtccgaggacgaagggaggacgaggtctagacttattagttgtacaattacaaacacgaacctaaccgtagtttacggttaacctttagttcgttacgttacgggaaacttcggaccgttaaccgtaaacggttccgtaaaccgtcgttacgggttcaccggaacccgaaacggcccaaccctcgttacgtccgaacgtttcccg

SEQ ID NO: 390332 - DNA, 640 bp, Homo sapiens
  misc_feature: GZ8MTXP01E1X0Q.52.86.H09.1.454.CMB.2.raw
  modified_base (223)..(223): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgganatgcattgaccaaacgatatgcttatgtacagcagagccggcagccctgtgtggtgatagtaataagacacgtgagacggcccctagagggtactcccgtagagcgtatttccctcgtggcctccgaggtaccgaagggaaccaacgggtcacgtagttcggaccagtcaaggtggacgtccgaggacagggaacggacgaggctagacttaagttattgtactaaatacaaagacgaacacctagtttaggtaacctttaagtgttcgttacgggaacttcggaaccgttaaccggtaaacggttccctaaaccccgggttcccgttcgggggttacccaacccggtaacccccggaaaacggtaaccccccaaaacccccggtactttccggtaacccgttaacccgtttccccg

SEQ ID NO: 390333 - DNA, 608 bp, Homo sapiens
  misc_feature: GZ8MTXP01A9I51.52.86.H09.1.454.CMB.2.raw
  modified_base (245)..(245): a, c, t, g, unknown or other
  modified_base (299)..(299): a, c, t, g, unknown or other
  modified_base (590)..(590): a, c, t, g, unknown or other
  modified_base (601)..(601): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgctattcgaccaaacgtntatgtacttattggtacagacagacgccggcacggccctgtgtggtgatagtanaaagacactggacgacggccctagacggtactcccgttaggacgctacttcccgtctcggctcgacggtaacgagggaaccaaacgtcgaactagttcggacctagtacgaggtcggaacgtccgaggaccgaggaacgggtacggagggtactagtaacttagtttattacgactaaactacgaaacacgtaactaccgtagtttcgtaacttgtacgttacgtacgacgttcgacgttacgacgttccgtacgtcgttaggttccacggaaccccacgtaacccaaccngttaccgtccncgttccc

SEQ ID NO: 390334 - DNA, 575 bp, Homo sapiens
  misc_feature: GZ8MTXP01CL35Y.52.86.H09.1.454.CMB.2.raw
  modified_base (222)..(222): a, c, t, g, unknown or other
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattcgaccaaacgntatgcttattggtaccagcagaagcgagggccaggccctgtgttggtgatgtaataaagacacgtgaggacggccctgaggggtactcccgtgacgcgtacttctcgtggctcccgaaggtcgaagggacaacgggtcacgattcggcatcgagtggacgtcgaggcaggacggacgaggctagtactattagttcggtactaagtacaaacgagtaaccactaagtttacggttaactttagtgttcgtttcggaacttcggacgtaaccgacggtccaccgttccgttgggttccaacgacccgaacggacccacccgacgtcgttcgtaacc

SEQ ID NO: 390335 - DNA, 746 bp, Homo sapiens
  misc_feature: GZ8MTXP01COBSJ.52.86.H09.1.454.CMB.2.raw
  modified_base (244)..(244): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagcccacctggtgtcagtcgtccccaggacagacggccaggatcacctgctctggagatgcattcgaccaaacgntatgcttatgtaccagcagaacgccggcacggcccctgtgttggtgatagtaataaagacacgtaggagacggccctacgagggactcccgtggacgtccgtacttcgtcgtcgggccttaccggaacggttccgaacggggtaaccaaaccggggttaccaaccgtaggtttacgggaccctagttaccgaagggttcgggacgtacccgaagggacccgaagggaacgggtaacccggagggtaccgtaaggtaacctttaaaggtttatttacggttaaccaaattaccgaaacgtaacggaaaccctaacccgtaagttttacgggttaaactttacgttcggttaaccgtttaacggaaaccgttcggaaccgttaaacccggtaaacgggttaccccttaacccgggtttcccggttacggggttaacccgaaacccggtaaccccgaaaaccggggtacccccaaaaccccggtaaccttttccgggtaaccccg

SEQ ID NO: 390336 - DNA, 646 bp, Homo sapiens
  misc_feature: GZ8MTXP01EO2WB.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggatcacctgctctggagatgcattcgaccaaaccgatatgtcttattggtaccagcagaacgccgggccacggccctggtgttggtgatgtaataaagacactgagacggccctcgagggactcccgtgacgcgtattcctcgtggctccgaggtcagggaactacggtcactagttcggccagtcgaggtggacgtccgaggcgaaggacggacgaggtcctagaacttagtttaattcgtaacgtaatacaaacgacgaaaccaccgtagtttacggtaactttagtcgttaccgttacgggtaaacttcggaccgttaaaccggtaacgggttccgtaaaccccgggttcgttacggggttccaacccggtaaccccgaaaaccgggcccccaaaaccccgtcggttaccgttaacccgttaacccgttttccccg

SEQ ID NO: 390337 - DNA, 568 bp, Homo sapiens
  misc_feature: GZ8MTXP01CYD4G.52.86.H09.1.454.CMB.2.raw
  modified_base (288)..(288): a, c, t, g, unknown or other
  modified_base (432)..(432): a, c, t, g, unknown or other
  modified_base (445)..(445): a, c, t, g, unknown or other
  modified_base (550)..(550): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacacgcccaccctcggtgtcagtcgtccccaggacagacggccaggatcactgctctggagatgcattcgaccaaacgatatgtcttagttggtaccagcagaacgccggcacgccctgtgttggngatgtaataaagacactgagacggccctgagggactccgtgagtcgattcctcgtggctccgaggtaacacgggaacaacggtcaatgtcggctagtcgagtggacgtcgaggacaggagacgaggctagacttattacgttanacaattcgaaaancgaaacctaccgtagttaggttaaccttatcgttaccgtaggaacttgaccgacgtaacggttcgaccggtcgttagggttccacgtaacccgaacgcccaaccncttacgtccaacgttccc

SEQ ID NO: 390338 - DNA, 619 bp, Homo sapiens
  misc_feature: GZ8MTXP01CKS3X.52.86.H09.1.454.CMB.2.raw
  modified_base (216)..(216): a, c, t, g, unknown or other
  modified_base (275)..(275): a, c, t, g, unknown or other
  modified_base (364)..(364): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgatatgcttatggtaccagcagagccggcaggccctgtgttggnatgtataaagacactgagacggccctgaggggtactcccgtgacgcgtatttcctcgtggctcgaggtcgaaagggaccaacggtcacngttggccatcgagtgagtccgaggcgaggaggacgaggtctaggtaacttattaagttcgtaacaaagttacaaacgtacgaaaccgtaccttagtttaggtacctttagtcgttccgtacggtaactcgggaaccgtaacccgttaaagggttcccaaccggttcccggtggggttcccgaccggaaccccgtaacgggaccccctaaaccccgtaacgttccggttacctaaccgtttcccggtttcccccgg

SEQ ID NO: 390339 - DNA, 617 bp, Homo sapiens
  misc_feature: GZ8MTXP01CRZ8R.52.86.H09.1.454.CMB.2.raw
  modified_base (316)..(316): a, c, t, g, unknown or other
  modified_base (329)..(329): a, c, t, g, unknown or other
tcagcgcagtacgacacgaccggtgctcgatttagtgctatagacttgggtttgggggctgtggttccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtaataaagacacgtgagacgcccncgaggactcccgngacgtccgtacttctgtcgcctaccgaggtcgagggaaccaacgggtcacagttcgggaccctagtcgtagggtggacgtacgacggacgaaggacgggacgagggcttaggtaacttagtttagttagtactaaatacaacgaacgtaccaaccttagtttaggtactttaagtcgttacttaacggtaacttggtacccaccggtaaacggtccttaccccgttcggttacgggtaacccacggaacccgtaaccgggaccccaaccccgtaacgttccgtaaccc

SEQ ID NO: 390340 - DNA, 693 bp, Homo sapiens
  misc_feature: GZ8MTXP01EPNOF.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccacctggtgtcagtcgtccccaggacagacggccaggactcacctgctcgtggagatgctattcgaccaaacgntatgtcttagtggtacagcagacgccggcacggccctggtgtggtagatgtaataaagactactgaagacgcctacgagggtactccgtagacgcgtatccgtacgtcggtcctacgacggtcgaaacgggaacgtaaacgggtccaacgtacgttcgggactagtccgagtagggacgtaccgaggaccgaggaacggaggtaacgtcgtagaaacctttattaaacgttcgtaacgtaaacggttacaaacaacggaacctaaccgtaagtttccggttaaactttagtcggtttaccgtttacggaaaccgttcgggaacccgttaaccgtaaacggggttaccctaaaccgggttcccgttacgggggttcccaacccgggtaaccccgaaaccgggaacccctaaaaccccgtcggttaccgttaacccgttcccttttaaccccgg

SEQ ID NO: 390341 - DNA, 612 bp, Homo sapiens
  misc_feature: GZ8MTXP01EWO9I.52.86.H09.1.454.CMB.2.raw
  modified_base (241)..(241): a, c, t, g, unknown or other
  modified_base (286)..(286): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattgacccaaacgntatgtcttatcggtaccagacagagccggcaggccctgtgtggtnatgtataaagcactgagacggccctacgagggtactccgtagacgcgtattccctcgtcggtcctccgaggtacgaacgggaacgaacgggtcaacgtagttcggactagtcgagtggacgtccgaggcgtaggaaggtacgaggctaggtacttaagttattcgtactaaattacaaacgacgacctaacctagtttacggttacttaagttgttacgttacgaacgttcgccgttaaacgtacggttccgtaaccggtcgttacggttaccgacgaacccgaacggtaaccccaacccgtacttcgtaaccttaacctttcccg

SEQ ID NO: 390342 - DNA, 578 bp, Homo sapiens
  misc_feature: GZ8MTXP01BAACE.52.86.H09.1.454.CMB.2.raw
  modified_base (225)..(225): a, c, t, g, unknown or other
  modified_base (244)..(244): a, c, t, g, unknown or other
  modified_base (286)..(286): a, c, t, g, unknown or other
  modified_base (293)..(293): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggcaggatcacctgctcgtgganatgctattcgaccaaacgntatgtcttatggtacagcagacgccggcacggccctgtgtgnatgtaanaagacagtgaggacgcccgtagaggtactccgtagacgtccgtattctcgtcggctaccgaggtcgaagggacgaacggtcacgtagtcggcctagtcgaggtcggacgtaccgagggaccgagggaacggacggagtctacgtaatttatttacggtagtactaatacaaacgagaaccctacgtatttacggtaacttagtcttcgtaacgacttgaccgttacgaaggtcccttacgttcgttacggaacaccgaaccgacgacccaacccgtgcgtaaccc

SEQ ID NO: 390343 - DNA, 774 bp, Homo sapiens
  misc_feature: GZ8MTXP01D6GTC.52.86.H09.1.454.CMB.2.raw
  modified_base (243)..(243): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacaggacggccaggatcacctgctctggagatgcattgaccaaaccgntatgtacttagtcggtaccagcaaggaacggccgggaccacggtcccctggtcgtttgggtagagttagtaaataaagacacgtaggaaggacggccccttacgaagggggtacctcccgttaggaggtcgtacttttccccgtcggtcgggccttacccggaaggggttaacccgaacggggtaaccgtaaacgggttccaaacccgttagtttccggggaccctaaggttccgaaggggttggtaccgtacccggagggaccaaaggggacggggaacggagggtcctagggtaaccttatttaagttacggtaacgtaaacttacgaaaaccgaaggtaacccaaaccttagtttaaggttaacctttagttccgttacgtttaaccggggaacttaaccggtaccgttaaaccggtaaaccggttccgtaaaccggttcccggttagggggttaacccaacccggggaacccctaaaacgggcccccctaaaaccccgtcggttacgttcccttaacccgtttcccg

SEQ ID NO: 390344 - DNA, 581 bp, Homo sapiens
  misc_feature: GZ8MTXP01BVVP5.52.86.H09.1.454.CMB.2.raw
  modified_base (440)..(440): a, c, t, g, unknown or other
  modified_base (564)..(564): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagccaccctcggtgtcaggtcgtccccaggacagacggccaggatcacctgctctggagatgcattcgaccaaacgatatgtacttattggaccagcagaacgcggccacggccctgtgtggtgatagtaataaagacactagagacggccctagagggactccctgacgcgtattcccgcgtggccctaccgaggtaacgaagggaacaacgggtacacgtaagttcggaccaatcgagtggacgaccgaggcaaggaaggtacgaagcgtanaattattaattgtacgaaatacaaacagaaccactattggtaacttagtcgtcgttccggaatcgacgttaccgaaaggttccaaccgttcgcgggttcaacgcccaaaggccccttaaacccncttctaaccgttctccg

SEQ ID NO: 390345 - DNA, 692 bp, Homo sapiens
  misc_feature: GZ8MTXP01CRXMD.52.86.H09.1.454.CMB.2.raw
  modified_base (241)..(241): a, c, t, g, unknown or other
  modified_base (283)..(283): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggactcactgctcgtggagatgcattcgaccaaacgntatgtacttatggaccagcagacgcggcacgcctgtcgtggnatgaataaagacactagaacgacgcccgttacgagggactcccgtagacgtacggtactttcccctcgtcggcctaccggaaaggttcgaaacgggaacctaaacggggttacaaacgttacgttacggggacctaacgttaccggaggttacgggaacggttacccggaaggggacccaaaggggtaacggggaaccggaggggtacctaggtaaaccgttaatttaacgttagttaacgaaaacttaccggtaaaacacggaaacctaaccgttaaacgtttaggttaaacctttagtacggtttaccgtaaccggtaacgttcggaacccgttacgaaacggttccgaaaccggtcttacggggcaccgaacccgaacgcccaacccctgttctccgaacttcccg

SEQ ID NO: 390346 - DNA, 570 bp, Homo sapiens
  misc_feature: GZ8MTXP01BOUIS.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaacgccgggccacggcccctgtgttggtgatgtataaagacactgagaggccctcgacgggactcccgtgacgcgtattccctcgtggcctccgaggtcaggggaacaacgggtcactagttggccatcgagtggagtccgagggcaggaggacggaggctagactattatgtacaactcaagaacgacaccctagttggtaaccttatcgtacttcggaactgacgaccgtaacgggcctaccggtccgttgggttccacggaaccccaacggtccccaaacccggcttaccgtccaacgttcccg

SEQ ID NO: 390347 - DNA, 613 bp, Homo sapiens
  misc_feature: GZ8MTXP01ECUE9.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatccacctgctcgtggagatgctattcgacccaaacgtatatgtacttagtcggtaccagcaaggaacggccggccgacggccctgtgttggtagatagtaaagtaaacgacacgtaggagacggtccctacggaagggtcctcccgtagacgtacgtacttccgtcgtggcctaccgaggtaaccgaagggtaaccaacggtcactagtcggaccagtcgaggtgacgtacgaggacgaggacggacgaggtctagtacttattagtacgtacaactacaaacagactactagtttagtacttagtcgttaccgttcgaacgtcgacgacgaaacggttccgaccgtcggttcgccgacgaacccgtaacggccccaacctacgttctaacccgaacttcccg

SEQ ID NO: 390348 - DNA, 746 bp, Homo sapiens
  misc_feature: GZ8MTXP01ACESR.52.86.H09.1.454.CMB.2.raw
  modified_base (225)..(225): a, c, t, g, unknown or other
  modified_base (247)..(247): a, c, t, g, unknown or other
  modified_base (301)..(301): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggactcacctgactcgtgganatgctagttcgaccaaaacgtntatgtacttagttcggtaccagcagaacgccggcacggtccctggtgttggtanagtagtaataaagacatagacgacggtcctacgacggtactccgtagaacgcggtacttccgtccgtggtaccgttaccgaggggtaccgaacggggaaccctaaacggggtacctaaacgttaacggtttccgggaccctaagttacccggtacgggttaggggtaaaccgtcccggaacggggaacaaggggaaaccgggttaccgggaggtacccgttaaagggttaacctttaaagtttaagggtttacgaaacccggttaaaacgtaacccgaaaaccgtaaccgtaaacccttaacgttacgtttaacggtttaacgtttacgttaccgttaaccggttacgtaacgttaacggaaccgttaaccgtacgttcccgtaaccgtcggttacggacacccgtaacccgaccgtaacccaacctgttaccgtcgttccgtcg

SEQ ID NO: 390349 - DNA, 619 bp, Homo sapiens
  misc_feature: GZ8MTXP01EXULZ.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacgggctctgaggcctcctatgagctgacacagccacctcggtgtcagtgtccccaggacagacggccaggatcactgctctggagatgcattgccaaacgatatgcttatggtaccagcagagccggcagccctgtgtggtgatagtaataaagacacgtgagacggccctagacgggactcccgtagacgcgtattcgtccgtcggctccgaggtccgaaacggggaaccgtaacggtcaactagttcgggaccctagtcgagtcggacgtccgagggcaggacgggacggaggtcgtagacttattattagtacaagtacaaacagaaccacctagtttcggttaacttagtcgttcgttacgggacttcggaaccgtaaccgttaacgggtccttaaccggtccgtacggggttaccaccggaccccgaaacgggtaccccaaaccccgtcgtacgttaccgtaaccgttcccgttccccg

SEQ ID NO: 390350 - DNA, 647 bp, Homo sapiens
  misc_feature: GZ8MTXP01A1GHT.52.86.H09.1.454.CMB.2.raw
  modified_base (247)..(247): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctcgtggagatgctattcgaccaaaccgtntatgtacttagttcggtaccagacaggaacggccgggccgacggtcccctggttcggttggtgagttaggtaaataaacgacacgtaggacggacggtccctacggagggtctacccgtagacgcgtacttccccgtgtcggcgtccgtaggtaaccgaacgggaaccgaacgggtcaacgtgttacgggacctagtccgaggtggacgtacgaggcgaggacggacgaggctagaacttagtattgtacaatacaacacgactacctagttacgttacttagtacgttaccgtacgtaactcggaaccgaacgtaacggttcccgtaacgggtccgttacgggttcaaccggtccccaaacgggtccccaaccgtcttacgtcccttaacgtttccccg

SEQ ID NO: 390351 - DNA, 734 bp, Homo sapiens
  misc_feature: GZ8MTXP01CCWEY.52.86.H09.1.454.CMB.2.raw
  modified_base (225)..(225): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgctattcgacccaaaccgtattatgtacttagttacgggtaccagcgaaggaacggcccgggccacgggtccccgtgttggttggtgatacgtaaataaacgacacgtgagcggcctacgacgggtactccgtagaacgtcgtactttccctcgtcggtcctcccggtaggtaaccgtaacggggaaccgtaaaccgggtactaaccgtagttacgggaccctagtaccgtaaggttcgggaacgttacccggagggaccgagggaaacggggacggtaacgggtcgtacggtaaacttagtttagtttacgtaacctaaagttaacgaaaccgaaacggtaccaaaccgttagtttacggttaaactttcggttacgttaccgtttacggaacgttcggaccgttaaccggtacgttccgtaacccggtcggttaccggttcaacccggtaaccccgtaacggaacccctaaccccgtacgttaccgtcccttaaccgtttccccg

SEQ ID NO: 390352 - DNA, 576 bp, Homo sapiens
  misc_feature: GZ8MTXP01ESWHU.52.86.H09.1.454.CMB.2.raw
  modified_base (227)..(227): a, c, t, g, unknown or other
  modified_base (245)..(245): a, c, t, g, unknown or other
  modified_base (260)..(260): a, c, t, g, unknown or other
  modified_base (282)..(282): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggactcacctgctcgtgganatgcattcgaccaaacgntatgcttatggaccngcagagcggcagccctgtgtgngatgtataagacactgagcggcctgaggtctccgtgagccgtattcgtcgtgcgtaccagggtcgagggaccaacgggtcacgtagttcggaccctagtcgaggtagggacgtccgaaggtcgaagggacggaccggaggaccgtagacttaagttaggttacgtactaatacgaaacgagacctaacctagttagtacttagtcgtcgttaacgaacttggaccgttacgacggtccaaccggttccgttacggtcgaccgcccgaacggccccaaccctcgttcgtaacccg

SEQ ID NO: 390353 - DNA, 734 bp, Homo sapiens
  misc_feature: GZ8MTXP01CNCDZ.52.86.H09.1.454.CMB.2.raw
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggctgggtccaggcgtggggacggtccctgagactctcctgtgcagcctcgtcggattcacctcacgtacccatagaaatgcacgtcgggtccgccgacggcctccgacggcgaacggggcgtagggaggtgggtggacgtagttagtacttccccgtatggtagtagggaaacgaccgtaaagtaacgccaaaccgtacgacgtaacggacgggtaccggtacgggaaacggggtaccgtaacgtttacggaacctacttacccgtaccgaaacggaacgtaaacccgaaaaccgttaacgaaaacggtaaacgtttaacccgggtttacctttaaccgtaaaacgttaaaacgttacgggaaaccaacggtacccgttaggaaaggtacgtaaccgtagggaaaccggaacgtaaccggtaaccgtttagtttacggttttacgtacgggttacggcggaacgggttacgggtaactcggtaacttaacgacgttacgaaccgttcccgaaacg

SEQ ID NO: 390354 - DNA, 843 bp, Homo sapiens
  misc_feature: GZ8MTXP01D8BBX.52.86.H09.1.454.CMB.2.raw
  modified_base (224)..(224): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgganatgcattcgacccaaacgatatgtcttattcggtacagacagacgccggcacggccctgtgtggtgtatagtataaagacactagagacggccctacgagggactcccgtggacgtacgtactttcccgtcgttcggggtacctcccggtaagggttacccgggaaacgggggtaacccgtaaaacccgggggttccaaaccgttaacggtttacccggggtaaccccgtaagttaacccggtaagggggttacggggaaccggttaaccgggaaacggggaccgaaacgggggtaaacggggaaccgggtaacggggtacccgttaggttaaaccttaaaggtttttaaactttaccgggttaacgtaaaaaccgttacctaaaaaccgaaacggtaaacccgtaaaccccttaaggttttacggttaaacgtttaacgttacgtttaccgtttaaccggggaacttaaccgggttaacccgggaaacccgttaaaccgggttacccgtaaaccccggttcccggttcgggggttaccaaaccgggaacccccgtaaaaccgggaaccccctaaacccccgtacgttacccggttaaccttaacccggttttcccccg

SEQ ID NO: 390355 - DNA, 595 bp, Homo sapiens
  misc_feature: GZ8MTXP01ARWCQ.52.86.H09.1.454.CMB.2.raw
  modified_base (182)..(182): a, c, t, g, unknown or other
  modified_base (244)..(244): a, c, t, g, unknown or other
  modified_base (286)..(286): a, c, t, g, unknown or other
  modified_base (297)..(297): a, c, t, g, unknown or other
  modified_base (366)..(366): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtntcagtcgtccccaggacaggacggccaggatcacctgctctggagatgcattgaccaaacgntatgtcttatggaccagcagacgccggcacggccctgtgtgngatgtataaancactgagcgcctcgagggactccgtgacgccgtattctcgtgctacgaggtcgagggacaacggtcacngtcgaccatcgaggtaggacgtaccgagggacaggtaggacgtaggctagaacttattagttcgtacaataccaaactacgaaccgtaacttagtttacggttaattattacggttcccgttaacggggtaaacttcggaaaccgttaccgtaaaccgggtccgttacccggttccgttacgggtccgacgaaccccggaacggtaccccaaacccgtcttccgtaacc

SEQ ID NO: 390356 - DNA, 632 bp, Homo sapiens
  misc_feature: GZ8MTXP01AW28M.52.86.H09.1.454.CMB.2.raw
  modified_base (240)..(240): a, c, t, g, unknown or other
  modified_base (327)..(327): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagacgccggcacggccctgtgtggtgatgtataaagacacgtagacgacggccctagagggactcccgngacgcgtattccctcgtggtcctaccgaggtaacgaaggggaacctaacgggtacacgtacgttcggacctaatcgaaggtggacgtccgaggctaaggacgggacgaggtactaggaacttaattagttacgtacgtaaacttacgaaacaacggaacctaaccttagtttacgggttaactttagtcgttacgtttaccggaagttcggacgttaaccggaaacggtttccgaaccgttccgttaggggttcccacgaaccccgaaccggcccaaaccccgtcgttactaaccgcgtttcccg

SEQ ID NO: 390357 - DNA, 677 bp, Homo sapiens
  misc_feature: GZ8MTXP01CHWIS.52.86.H09.1.454.CMB.2.raw
  modified_base (217)..(217): a, c, t, g, unknown or other
  modified_base (235)..(235): a, c, t, g, unknown or other
  modified_base (285)..(285): a, c, t, g, unknown or other
tcagcgcagtacgacacgaccggtgctcgatttagtgctatagacttggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggatcacctgctctgganatgctattgaccaaacgntatgtcttatggtacagcagaacgccggccacggcccctggtacgttggntatgtaataaagacacgtggagacggtccctagacgggactcccgtggacgcgtactttcgtccgtgggacctcgtaacgggtcgaaaacggggacccaacgggtacaacgtacgtttcgggacctagttcgaaggttcgggaacgttccggaacggggcgaaggtacggggaacggtagggtacctaggtacttatttaacgtggtaacaaacgttcaaaacgtacggaaaccctaccgtaagttttacggttaactttacgtacgttccgttacgggtaaactgaaccgtaaccgttaaacggtccgttaccgttaccggttggaccgaccggaaccccgaaccgaccccgtaaacccgtctcggttaccgtccgttccgtttaaccccg

SEQ ID NO: 390358 - DNA, 603 bp, Homo sapiens
  misc_feature: GZ8MTXP01BPGLO.52.86.H09.1.454.CMB.2.raw
  modified_base (306)..(306): a, c, t, g, unknown or other
  modified_base (345)..(345): a, c, t, g, unknown or other
  modified_base (370)..(370): a, c, t, g, unknown or other
  modified_base (387)..(387): a, c, t, g, unknown or other
  modified_base (502)..(502): a, c, t, g, unknown or other
  modified_base (541)..(541): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggcgtggggaggtccctgagactctcctgtgcagcctctggattcacctcagtacccatgaaatgcacgtgggtccccnccgaggcctccgaggcgaagggggcgtgggaggtggggngcaggttatatccctatgatggaanacaataagcacgtcganaggagtccggaggaacggcgattcgaccatcgtaccgagacgaacaacgtacgaaagtaacgttacgggtttacttaacgttaacgaaacttacgaaacaacgtccgtagaaggngtccgtaggacgacggaacgtacttattcggttttacgnggtcgcggttaaggacggggtaactcggtaacttacgacgttaccgaacgttcccgtaacgg

SEQ ID NO: 390359 - DNA, 643 bp, Homo sapiens
  misc_feature: GZ8MTXP01D4IRM.52.86.H09.1.454.CMB.2.raw
  modified_base (229)..(229): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacacgcccaccctggtgtcagtcgtccccaggacaggacggccaggatcacctgctgtgganatgctattcgacccaaacgatatgtacttagttcggaccaggcaaggaacggcccgggccacggcccctggtgttggtgatagtaataaagacatggacgacgccctggagggctccgtagacgcctacttctcgtcgcctaaccgagggtcgaacgggaaccgtaacgggtcacgtacgttcgggaccctattcgaaggtcgggactaccggagggacgagggaacgggacgaggtactaggtacttagtttacttgtaacaatacgaaactaacgactaaccttagtttacgtaacttagtcgttaccgtaacggtaacttcgaaccgttaacgtaaacggtcccttaaccggttccgttacgggtaaccacccggaacccgaacccggacccaccccgtgttaaccgtccc

SEQ ID NO: 390360 - DNA, 637 bp, Homo sapiens
  misc_feature: GZ8MTXP01BJC6B.52.86.H09.1.454.CMB.2.raw
  modified_base (231)..(231): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacaggacggccaggactccacctgctcgtgganatgctattcgaccaaacgtattagtgtacttagttcggtaccagacaggaacgcccgggaccacggtcccctggtcgttggtagtagtagtaataaacgactacgtaggacggacggtccctaggacgggtacctcccgtaggacgccgtacttcgtcgtggcctacgaggtcgagggactaacgggtcaacgtagtcggactagtcgaggtcggagtccgaggaccgaggacggacgacggtactaggtaacttagttagttacgtaacaaagttaccaaacgaacgtacgtaacctagtttcggtacttagtcgttacgtaacggtaacttcgacgacgtaacggtccttaccgttcgcgggtaacaccggtaaccaccggacccaacccgtgttccgtaaccc

SEQ ID NO: 390361 - DNA, 658 bp, Homo sapiens
  misc_feature: GZ8MTXP01EK7CU.52.86.H09.1.454.CMB.2.raw
  modified_base (243)..(243): a, c, t, g, unknown or other
tcagcgcagtacgacacgaccggtgctcgatttagtgctatagacttgggtttgggggctgtggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgctattcgaccaaacgntatgcttatggtaccagcagaacgccggccacggccctgtgtggtgatagtaataagacacgtgagaccgtcctagaggtactccgtagacgtccgtacttcgtcgtcggtccctaaccgacgggtaacggaacgggaaaccgtaaccgggtaccaacgttacggttcgacccgtatcgtagggttcggaacgtaccgaagggaccgaaagggacgggacgagtccgtaagttagttaacgtttaggttcgtaactaactaacaaagaacgaactaccgtagtttagttacttacgttcgtaccgttaacggtaacgttcggtaaccgaaccgtaacggtaccccgttaccggttcgttacgggtaaccaccggaacccgtaacggaccccttaaaccgtccgttcgtaaccccg

SEQ ID NO: 390362 - DNA, 814 bp, Homo sapiens
  misc_feature: GZ8MTXP01APPRK.52.86.H09.1.454.CMB.2.raw
  modified_base (246)..(246): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagccaccctggtgtcagtcgtccccaggacagacggccaggatccacctgctcgtggagatgcattcgacccaaaccgtntatgtacttattggtacagacaggaacgccgggccacggccccgtggtggttggtgtagtagtaaactaaacgacacgtggaacggacggtccccgtagacggggtacctcccgtggaacgcgtacttcccgtcgttcggccctcgaggtacgaagggtaaccgaaaccggtcaacgtactttcgggaccctagtaccgagggttacgggaccgtacccggagggacgaaaggggaacggggtaaccggagggtacccgttaggtaaacctttaagtttaaacttttacggaaaccgttaaacgttaacctaaaaccgaacggtaaaaccccgttaacctttaaagttttacggggtttaaaccctttttaaggtttacggtttacccgtttaaaccgggtaaccgttaaccgggtaacccggaaaccccggttaaacgggttccccggttaaacccccgggttttcgaccggggggttacccaaccccggtaacccccgggtaaaccgtaacccccccgaaaaccccgtacccggtttacgttccccgttaaccccttttcccccgg

SEQ ID NO: 390363 - DNA, 653 bp, Homo sapiens
  misc_feature: GZ8MTXP01AILMX.52.86.H09.1.454.CMB.2.raw
  modified_base (274)..(274): a, c, t, g, unknown or other
  modified_base (304)..(304): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggctggtccaggctgggaggtccctgagactctcctgtgcagcctctggattcacctnagtaccccatgaatggccacgtgggtcccncacggctccgagggcaacgggggctgggacgtggggtggcagttatactccctatgagtcggaatacaaataacgcaacgtacgccaggagtccggagaacgggcccgaattcggaacctatcgtaccccgagggaacaaccgaacgtacggtaaataacgttacgggtttaccgttaccgtaaactaaaagttccggaaaactacgggaccttacggaacggtaagcccgttaaggaacggaacgtaaccggggttccttaaagtttcgggtttttaaaccgtggtacggaggttacggttaacgggtaacgtacgtaacgtacgcggactaaccggaacccgtaacg

SEQ ID NO: 390364 - DNA, 530 bp, Homo sapiens
  misc_feature: GZ8MTXP01DSO1Y.52.86.H09.1.454.CMB.2.raw
  modified_base (264)..(264): a, c, t, g, unknown or other
  modified_base (295)..(295): a, c, t, g, unknown or other
  modified_base (299)..(299): a, c, t, g, unknown or other
  modified_base (304)..(304): a, c, t, g, unknown or other
  modified_base (313)..(313): a, c, t, g, unknown or other
  modified_base (319)..(319): a, c, t, g, unknown or other
  modified_base (344)..(344): a, c, t, g, unknown or other
  modified_base (423)..(423): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttggggttttcctcgttgctcttttaagaggcgtccagtgtcaggtgcagctggtggagtcgtgggggggcgtggtccaggctgggaggtccctgagactctctgtgcagcctntggattcactcagtaccatgaatgcatggcncagnccagnaggatgagnggtggnagtatatcctatgagtgagacaaanaagacacacgacagagacgtagacgacgatacgacactacacagagacaacgacgaagtaatacgttacgttaactaanaaactaagaacagacgagaagacgacgtagaggaacgaacgtacgttattagtttagtgtgacgaggaagggaagtacgtaagtactacgactaacgaaccgtaacg

SEQ ID NO: 390365 - DNA, 635 bp, Homo sapiens
  misc_feature: GZ8MTXP01C68QV.52.86.H09.1.454.CMB.2.raw
  modified_base (218)..(218): a, c, t, g, unknown or other
  modified_base (234)..(234): a, c, t, g, unknown or other
  modified_base (250)..(250): a, c, t, g, unknown or other
  modified_base (274)..(274): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccctcctcactctctgcacaggctctgaggcctctatgagctgacacagccaccctggtgtcagtgtccccaggacagacggccaggatcactgctctgganatgcattgccaaacgntatgcttatgtacagnagagcggcaggccctgtcgtggtnatgtataaagacactagagaggccctgagggactccgtagagcggtacttccgtctggctcgaggtaaccgagggcctaaacgggtacacgagttcggacctagtcgagtggacgtcgaaggctaagggagacgagcgttagacttagttatacggtacgtaaacgttacgtaaaccagggtaacctaacccgtaacgtttgggttaaaccctttaagtcgtttacgtttaccggaacgttaacgaccgggttaaaccaacggggtttccaaaccgggtcccgttaaaggggttcccaaacgggtccccgaaaacgggtccccaaaccccgtacggttaccgtaacccgttcgtttccccg

SEQ ID NO: 390366 - DNA, 694 bp, Homo sapiens
  misc_feature: GZ8MTXP01DYYZR.52.86.H09.1.454.CMB.2.raw
  modified_base (325)..(325): a, c, t, g, unknown or other
  modified_base (597)..(597): a, c, t, g, unknown or other
tcagcgcagtacgacacgaccggtgctcgatttagtgctatagacttggggtttgggggctgggagacgagcccagcactggaagtcgccggtgtttccattcggtgatcatcactgaacacagaggactcacatggagtttgggctgagtcttggggttttcctcgttgcttcttttaagaggcgtccagttgtcgaggtgcaggcgtgggtggaggtcggtgggggggggctggtccagggcgtggggacggtccctgagtactctccgtgtcgcagcctgtggtattccactcacgtacccatagaatgcacgtgggtcccncgacggctccgaggcgaagggggctgggagtggggtgctagttactatcccctagtgagtaggaagtaacaaagtaacgactaaccgtacgacgtaaggacggtaccggtagggaaacgggtccgtaaagttcggaacctaacttcccgtaacccgaaagtaacgaaacccgtaaacgtacgaaaggttaaacgttaccggtttaacgttaactaaacgtaaaatacggaaacacggtacctagagagaccgtagacggtacgaaccggttnttagtttacgttttacgtaggtcgttacgggaacggttacgggtaaacgttacggtaactttaacggacgttaccgaaccgttaaccccgtaaaagg

SEQ ID NO: 390367 - DNA, 606 bp, Homo sapiens
  misc_feature: GZ8MTXP01BUV8Q.52.86.H09.1.454.CMB.2.raw
  modified_base (286)..(286): a, c, t, g, unknown or other
  modified_base (581)..(581): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgtcttatggtaccagcagaacgccggccaggccctgtgtggngatgtataagacactgagacggccctacgagggactccgtgacgcgtattccgtctggcctcgaggtacgagggaacacgggtcactgttcggccaagtcagtaggacgtcgaggcaaggacggagaggctgtacgtattattgaccaaagtccaaacgtagaacctaaccgtagttacggttaaccttagttcgttaccgttacggaacttggaacccgttacggtaaacgggttcctaaccgggttccgttacgggttccacggaaccccaaacgggccccaaaaccccggtnttccggtaacccttaaccttccccg

SEQ ID NO: 390368 - DNA, 673 bp, Homo sapiens
  misc_feature: GZ8MTXP01AOCDD.52.86.H09.1.454.CMB.2.raw
  modified_base (226)..(226): a, c, t, g, unknown or other
  modified_base (293)..(293): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacacgccaccctcggtgtcagtgtccccaggacagacggccaggactcactgctctgganatgcagttcgaccaaaccgtatatgtcttattggaccagcagacgccgggcacggcccctgtgtggngatagtaataaagactacgtgaacgcggccctgagggtctcccgtaggacgccgtacttcgtcgacggtcttaacccgagggtcgaacgggaaccaacgggtcactagttcgggaccctagtacaggtgggaactccgaagggccaagggacggacggtacggcttacggaactttaacgtttagttacgtaccaaaattaccaaacgtagtaaacctacccgttaaagttttcggttaactttaacgttccgggttacctttaaccgggaaaacttcggaccgaaacccgtaaacgggttccttaaccccggttcggttacgggttaacgaacccgtaaccccgaaacgggccccaaaacccgtccgttcgttaacccc

SEQ ID NO: 390369 - DNA, 725 bp, Homo sapiens
  misc_feature: GZ8MTXP01BC8M3.52.86.H09.1.454.CMB.2.raw
  modified_base (224)..(224): a, c, t, g, unknown or other
  modified_base (260)..(260): a, c, t, g, unknown or other
  modified_base (706)..(706): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctcgtgganatgcactgaccaaagcaatagttgttatggtacagnagagccgaggcccacggtaccccttagtggtagtatataaagtacggacagtgagacggccctacgagggactccgagacgtacgtagttcctcgtcggtcctacccgtcgtcggaaacgggacctaacgacgtaccgtagttaggacttacacgttaccggtaggggttacggggtacccgggtaccggggaacgaaggggttaaccgggggtaaaccggagggggtaaccttaaccggttaaaggttactttaaacccggttagttaaccaaacgggtaactaaaacggtaaacgtaaccggttaaacgtaggggtttaaccggttaacgtttacggtttaggtacggttcggtaaccggtttacggggggccggaacggggttaaaccgtacggccgtacggtcccgttcgttacggttcgaacgaccgtaacgcccgtcccnccgtcccggttaactcccg

SEQ ID NO: 390370 - DNA, 741 bp, Homo sapiens
  misc_feature: GZ8MTXP01BNLAF.52.86.H09.1.454.CMB.2.raw
  modified_base (299)..(299): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccacccgtcggtgtcagtcgtcccccaggacagacggccaggatcacctgctcgtggagatgcattcgaccaaaccgtatatgtcttagttggtaccagcagaacggccggtcacggtccctggtcgtggtnagtcgtaaataaacgacacgtggagaccggccctacgagggtactcccgagacgcgtactttcccgtcgtcggccctaccgacgggttaaaccgacgggaaccgtaaacgggtctaacgtacgttcgggtacccagtcggtaggtaggaaccggtccgaagggtaccgaagggtaacgggacggacggtactaggtaacttaagtttagttacggttaccgaaaatttaccgaaaacacggtaaccaaaccgttagtttacggttaaacctttagttccgttacgttaaccgggtaacgtcggaacccggaaccgttaacgggttcccctaaaccgggtttcccgttacgggggttaacccacccggtaaacccccgtaaacccgggaacccccttaaaacccccgtaccggttaccgttaacccgttaacccggttccccg

SEQ ID NO: 390371 - DNA, 592 bp, Homo sapiens
  misc_feature: GZ8MTXP02F9O23.52.86.H09.1.454.CMB.2.raw
  modified_base (286)..(286): a, c, t, g, unknown or other
  modified_base (446)..(446): a, c, t, g, unknown or other
tcagcgcagtacgacacgaccggtgctcgatttagtgctatagacttgggtttgggggctgtgggttccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagagccggcaggcccctgtgtgngatgtataaagacactgagacgccctgagggactccgtgacgccgtattctcgtcggtcctaccgagggtcgaggggaaccaacgggtaccactagttcggacctatcgaggtggacgtccgaggcaggacggacgagggctagacttattattacgtanaactacaacacgacactagttacgtacttagtgttacgtacggtaactcgaccgtaaccgtaaacggtccgtaacccggttcgttacgggggtaaccaccggaccccgtaaaccgggacccccaaaaccccgtcgtaccgtacccc

SEQ ID NO: 390372 - DNA, 500 bp, Homo sapiens
  misc_feature: GZ8MTXP02GQ4YX.52.86.H09.1.454.CMB.2.raw
  modified_base (420)..(420): a, c, t, g, unknown or other
  modified_base (469)..(469): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagaggccctgagggatccctgagcgattcctctggctccgaggtccagggacaacggtcacattggccatcagtggagtccaggcagagacgaggctgactagttatgtacaatcaanagacactattgtacttatgtcttcggaactgacgacaaggtcaccgtcncggtcacgccaaggccacccatcgtcactcc

SEQ ID NO: 390373 - DNA, 575 bp, Homo sapiens
  misc_feature: GZ8MTXP02H1HMZ.52.86.H09.1.454.CMB.2.raw
  modified_base (224)..(224): a, c, t, g, unknown or other
tcagcgcagtacgacacgaccggtgctcgatttagtgctatagacttgggtttggggctgtgggttccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaacgatatgcttattggtaccagcagaagccggccaggcccctgtgttggtgatgtaataaagacactgagacgcctgaggactccgtgagccgtattctcgtcggctccgaggtccgaaggggacaaccggtcaactagttcgggaccatcgaggtggacgtccgaggcaggaggacggaggctagacttattatgttacaatacaaacagaccaactagttggtaacttagtcgttacgttacggaaacgttgaccgtaaacgaacggtaccaacccggttccgtacgggtaaccgacggacccgaacggaccccaaaccccgtacgtttacccgcg

SEQ ID NO: 390374 - DNA, 507 bp, Homo sapiens
  misc_feature: GZ8MTXP02IWD8F.52.86.H09.1.454.CMB.2.raw
  modified_base (236)..(236): a, c, t, g, unknown or other
  modified_base (279)..(279): a, c, t, g, unknown or other
  modified_base (427)..(427): a, c, t, g, unknown or other
  modified_base (429)..(429): a, c, t, g, unknown or other
  modified_base (499)..(499): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctggagatgcattgccaaacgntatgcttatggtaccagcagaagccggcacggccctgtgtggngatgtataaagcactgagacggccctagagggactcccgtgagcgtattcctcgtgctcgaggtcgagggacacgggtcaactgttggaccatcgagtggacgccgaggcaaggacggacgaggctagtactattatgtacaatcaananacacatttcgattatgtacttcggaactcgacgtacaggtcacgtcgacggtcacgccaagtccaacccntcactctc

SEQ ID NO: 390375 - DNA, 516 bp, Homo sapiens
  misc_feature: GZ8MTXP02H8ITM.52.86.H09.1.454.CMB.2.raw
  modified_base (221)..(221): a, c, t, g, unknown or other
  modified_base (238)..(238): a, c, t, g, unknown or other
  modified_base (254)..(254): a, c, t, g, unknown or other
  modified_base (334)..(334): a, c, t, g, unknown or other
  modified_base (430)..(430): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtaccngcagaagccggccaggcccctgtgttggtgatgtataaagacactgagacggccctagagggatcccgtgagcgattccnctggctcgaggtcagggcaacgggtcaacgtattggccatccagttggagtaccaggcaggaggacgagggctagactattattgtacaattcaanagacacagtaggtactatgtattcggaacttgacgtacagtcaccgtcgcggtcacgaacccgacgcccaaccactcgactactcc

SEQ ID NO: 390376 - DNA, 492 bp, Homo sapiens
  misc_feature: GZ8MTXP02GAZAM.52.86.H09.1.454.CMB.2.raw
  modified_base (313)..(313): a, c, t, g, unknown or other
  modified_base (334)..(334): a, c, t, g, unknown or other
  modified_base (482)..(482): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattccnctggctccaggtcagggcaacggtcacattggccatcagtgagtcaggcagagacgagctgactattatgtacatcaacagacaccattggtacttatgtcttgaactgacgacacggtcacgtctggtcacgccaacggccaacccntcgcactccc

SEQ ID NO: 390377 - DNA, 520 bp, Homo sapiens
  misc_feature: GZ8MTXP02GS6SB.52.86.H09.1.454.CMB.2.raw
  modified_base (238)..(238): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgtggtgatgtataaagcactgagaggccctgagggatccctgagcgtattcctctggctccaggtcagggcaacggtcacattggcatcagtggagtccaggcagagacgagctgactattatgtacaatcaacagacacctagttggtaacttatgtacgtacggaactgacgaccaaacggtccaccgtctacgggtccacgcccgaacggaccccaaccccgactcgtaccacgttcccg

SEQ ID NO: 390378 - DNA, 479 bp, Homo sapiens
  misc_feature: GZ8MTXP02I69EK.52.86.H09.1.454.CMB.2.raw
  modified_base (237)..(237): a, c, t, g, unknown or other
  modified_base (316)..(316): a, c, t, g, unknown or other
  modified_base (393)..(393): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (403)..(403): a, c, t, g, unknown or other
  modified_base (405)..(405): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagaagcggcaggcccctgtgtgtgatgtataaagcactgagaggccctacgagggactcccngagacgtattcctctggctccgaggtcagggacaacggtcacatgcatcagtgatcagcagagcgagctgacatatnananananananacatagtatatgtgtacgactacgacgacgacgtacacgtcgtcgtcgacgaacgacgaccaccacactcactc

SEQ ID NO: 390379 - DNA, 507 bp, Homo sapiens
  misc_feature: GZ8MTXP02FUXD3.52.86.H09.1.454.CMB.2.raw
  modified_base (239)..(239): a, c, t, g, unknown or other
  modified_base (312)..(312): a, c, t, g, unknown or other
  modified_base (495)..(495): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccaggcccctgtgttggtgatgtataaagcactgagaggccctnagggatccctgagcgattcctctggctccaggtccagggcacggtcacattggccatcagtggatccagcagaggacgaggctgactattatgtacaatcaacagacaccattggtacttatgtcttcggaactcgcgaccaaggttcaccggtctacgggtcacgcccaaggcccaaacccntcgtacacttcc

SEQ ID NO: 390380 - DNA, 497 bp, Homo sapiens
  misc_feature: GZ8MTXP02GFEAE.52.86.H09.1.454.CMB.2.raw
  modified_base (239)..(239): a, c, t, g, unknown or other
  modified_base (287)..(287): a, c, t, g, unknown or other
  modified_base (313)..(313): a, c, t, g, unknown or other
  modified_base (335)..(335): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtnatgtataaagacactgagaggccctnagggatccctgagcgtattccnctggctccaggtcagggcaacggtcacattgccatcagtgagtcaggcagagacgaggctgactattatgtcaatcaacagacacctataggtacttatgtcgttcggaactgcgtaccaaggtcacgtcctggtcagcccaggccaacccgctacgcactc

SEQ ID NO: 390381 - DNA, 486 bp, Homo sapiens
  misc_feature: GZ8MTXP02G1KPB.52.86.H09.1.454.CMB.2.raw
  modified_base (238)..(238): a, c, t, g, unknown or other
  modified_base (356)..(356): a, c, t, g, unknown or other
  modified_base (408)..(408): a, c, t, g, unknown or other
  modified_base (424)..(424): a, c, t, g, unknown or other
  modified_base (452)..(452): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggtgatgtataaagacactgagaggccctgagggatcccgtgagcgattcctctggctccgaggtcagggcaacggtnacgattgcatcagtgagtcagcagagcgagctgactattatgtacaatcaanagacacatgtactatntctgaactcgacgacaaggtcaccgtcncggtcacgccgaacgccaacccatcgtcacgtcc

SEQ ID NO: 390382 - DNA, 597 bp, Homo sapiens
  misc_feature: GZ8MTXP02HNMY0.52.86.H09.1.454.CMB.2.raw
  modified_base (240)..(240): a, c, t, g, unknown or other
  modified_base (285)..(285): a, c, t, g, unknown or other
  modified_base (485)..(485): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccgggccaggccctgtgttggngatgtaataagacactgagacggccctgagggactcccgtgagcgtattccctcgtggctccgaggtccgaggggacctaacgggtcaacgtagttcgggccaatccgagttggacgtcccgagggcaaggaggacggaaggctggaacttattagttgtacaaattcaaacagaaccaaccgtagtttacggtaacttntacggttactttacgggaaacttcgaccgaccgtaaacggttcaacccgttccgtcgggtaccacggaaccccgaaacggccccaaacccctagtccgtctaacctttcccg

SEQ ID NO: 390383 - DNA, 512 bp, Homo sapiens
  misc_feature: GZ8MTXP02GRQL6.52.86.H09.1.454.CMB.2.raw
  modified_base (238)..(238): a, c, t, g, unknown or other
  modified_base (425)..(425): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttgtgatgtataaagacactgagacggccctgagggactccctgagcgtattccctcgtggctccgaggtcaagggacaacggtcacattcggccatcagtggagtccaggcaagacggacgaggctgactattatgacaatcaanagacactattgtacttatgtactacgaactcgacgacaacggtcacgtcgtggcacgaacccgacgaccaacccatcgtacactccg

SEQ ID NO: 390384 - DNA, 636 bp, Homo sapiens
  misc_feature: GZ8MTXP02H4JH7.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtcccaggacagacgccaggatcacctgctctggagatgcattgaccaaacgatatgcttatgtaccagcagaagccggccaggccctgtgttggtgatgtaataaagacactagagacggcctcgagggactcccgtagagccgtattccctcgtcggcctaccgaggtaccggaagggaccgtaaaccgggtcaccgtagttcgggaccctatccgaagtcgggacgtacccgaagggacgaaggagggaccgaggtcgtaagtactttaagttagttcgttaacaaacttacaaacgacaactaacctagttacggtaacttagttcgttacgttaacgaacttcggaccgtaaccgtaaacggtcccaccggttaccgtacggggttaccaaccggaaccccgaacggaccccaacccccgtatacccgtaccctaactttccccg

SEQ ID NO: 390385 - DNA, 518 bp, Homo sapiens
  misc_feature: GZ8MTXP02GWNNF.52.86.H09.1.454.CMB.2.raw
  modified_base (232)..(232): a, c, t, g, unknown or other
  modified_base (277)..(277): a, c, t, g, unknown or other
  modified_base (416)..(416): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgtggngatgtataaagacactgagaggccctgagggactccctgagcgattctccgtggctccgaggtcgaggggacacgggtcaactagttgccatcagtgagtccaggcaggaggacgagctgactattattgcaaatcaanagacaccattggtacttatgtcttaggaactgacgacaaggtcaccgttcgtcgggtcacgacccgaacgaccccaaacccgactacgtaccactcttcccg

SEQ ID NO: 390386 - DNA, 547 bp, Homo sapiens
  misc_feature: GZ8MTXP02JK6HM.52.86.H09.1.454.CMB.2.raw
  modified_base (240)..(240): a, c, t, g, unknown or other
  modified_base (427)..(427): a, c, t, g, unknown or other
tcagcgcagtacgacacgaccggtgctcgatttagtgctatagacttgggtttggggctgtggttccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggcccctgtgtggtgatgtataaagacactgagacggcctcgagggactcccgtagagccgtattctctggctcgagtcgagggacacgggtcacgtattcgggccatcgaggttggacgtccgaggcaggacggacggagctagactattatgtanaatacaaacagaacacctattggtaacttatcgttcgttacggaactggaccgaccgaaacggttccaaccgtccgttacgggaacacgacccgaacggcccaacccctacgtcgtaccc

SEQ ID NO: 390387 - DNA, 530 bp, Homo sapiens
  misc_feature: GZ8MTXP02JLBGF.52.86.H09.1.454.CMB.2.raw
  modified_base (238)..(238): a, c, t, g, unknown or other
  modified_base (438)..(438): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagacggccctcgagggactcccgtgagcgtattccctctggctccgaggtcgaaggggaccaacgggtcacgagttcggaccatcgaagtggacgtccgaggcagaggacgaggctgactattatgtacaatcaanagacacattgtacttatgttactcgaactgacgaccacggtcaccgtcgtcgggtacacgccgaacggacccaacccgatcgaccactcccg

SEQ ID NO: 390388 - DNA, 515 bp, Homo sapiens
  misc_feature: GZ8MTXP02FNQSC.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtgttggtgatgtataaagacactgagaggccctcagggatccctgagcgattcctctggctccaggtcaggggcaacgggtcacattggccatcagtgagtccaggcagaggacgaggctgactattatgacaatcaacagacaccattggtacttatgtcttacggaactgacgacgaacgtcaccgtccgtgggtccacgcccgaacggcccaaaccccgctacgtccacttccg

SEQ ID NO: 390389 - DNA, 492 bp, Homo sapiens
  misc_feature: GZ8MTXP02F8E2D.52.86.H09.1.454.CMB.2.raw
  modified_base (238)..(238): a, c, t, g, unknown or other
  modified_base (311)..(311): a, c, t, g, unknown or other
  modified_base (404)..(404): a, c, t, g, unknown or other
  modified_base (411)..(411): a, c, t, g, unknown or other
  modified_base (429)..(429): a, c, t, g, unknown or other
  modified_base (484)..(484): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtacagcagaagccgggccaggcccctgtgttggtgatgtataaagacactgagaggccctnagggatccctgagcgattcctctggctccaggtccagggcaacggtcacatggccatcagtgatccagcagagcgagctgactattattgtanaatcaanagacaccattgtacttangtcttggaactgacgacaaggtcaccgtctagggtcagcccaaggccaaaccccntctcactc

SEQ ID NO: 390390 - DNA, 672 bp, Homo sapiens
  misc_feature: GZ8MTXP02INUPW.52.86.H09.1.454.CMB.2.raw
  modified_base (212)..(212): a, c, t, g, unknown or other
  modified_base (672)..(672): a, c, t, g, unknown or other
tcagcgcagtacgacacgaccggtgctcgatttagtgctatagacttgggtttgggctgggagacgagcccagcactggaagtcgccggtgtttccattcggtgatcatcactgaacacagaggactcaccatggagtttgggctgagcgtggtttcgcgtaggctctttaagaggctcagtgtcaggtgcagctggtggagtgtggggggnggtggtcgaggcgtgggcggtccgtgagactctcgtgtgcgcgcctcgtgtacttctaccttctacgtacctatagaagtacgacgtacgtcggtccgccgacggcgtccgacggacggaacggggcggtagggtaggtggggtgggtacgtagttacgttacgtaccgtagtagtagtaggtaagaacgtaaagtacgtacgtaacgtaaccgtacgaacgtaacggtaccggtacgggtaacgggtaccggtacgtacgtaccgtacgtaccgtaccgaacgaacgaacgaaacgtaacgtaaacgtaaacgttaacgttacgttaacgttaaacgtaaaacgtaacgtaaacgtaacgtaccgtacggtacgtacgacgtacggtaacggaacggtaaccggtacgttacgtttacgtttacgttacggtacggtacggtaacggtaacgggtaacn

SEQ ID NO: 390391 - DNA, 510 bp, Homo sapiens
  misc_feature: GZ8MTXP02G44XD.52.86.H09.1.454.CMB.2.raw
  modified_base (238)..(238): a, c, t, g, unknown or other
  modified_base (310)..(310): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgttggtgatgtataaagacactgagaggccctnaggggatccccgtgagcgattcctctggctccgaggtcagggaccaacggtcacgattggccatcagtgagtccaggcagaggacgaggctgactattatgtacaatcaacagacaccattggtacttatgttcttacggaactcgcgacaacgtcaccgtctggtcagcccgaaggcccaacccgactcgtccacttcc

SEQ ID NO: 390392 - DNA, 528 bp, Homo sapiens
  misc_feature: GZ8MTXP02JMGIZ.52.86.H09.1.454.CMB.2.raw
  modified_base (237)..(237): a, c, t, g, unknown or other
  modified_base (279)..(279): a, c, t, g, unknown or other
  modified_base (418)..(418): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtaccagcagaagccggcaggcccctgtgtggngatgtataaagacactgagaggccctgagggatcccgtgacgcgtattcctctggctccaggtcagggcaacgggtcacattggccatcagtggagtccaggcagaggacgagctgactagttatgtacatacaaccanacactagttagtactatcgttacgtacgacgtcgacgaaccgacggtccgtaccgtccgtacggtacaccgaacccgaacgaccccaacccgactaccgacctacgtccg

SEQ ID NO: 390393 - DNA, 550 bp, Homo sapiens
  misc_feature: GZ8MTXP02GINBX.52.86.H09.1.454.CMB.2.raw
  modified_base (236)..(236): a, c, t, g, unknown or other
  modified_base (279)..(279): a, c, t, g, unknown or other
  modified_base (360)..(360): a, c, t, g, unknown or other
  modified_base (363)..(363): a, c, t, g, unknown or other
tcagcgcagtacgacacgaccggtgctcgatttagtgctatagacttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagagccgggcaggcccctgtgtggngatgtataaagcactgagacggccctgagggactccctgagcgtattccctcgtggcctccgaggtcaggggcaacgggtnacngttggccatcagtgagtccgaggcagaggcgagctgactattatgtcaatacaactagaccaccgtattacggtacttagtcgtcgttacggaactcgacgtaccgaaaggttccaccggtcccgtcggggtaccacgaaccccgaaacggaccccaaccccgtagtccggtacctaaccgttcccg

SEQ ID NO: 390394 - DNA, 517 bp, Homo sapiens
  misc_feature: GZ8MTXP02J0MRZ.52.86.H09.1.454.CMB.2.raw
  modified_base (319)..(319): a, c, t, g, unknown or other
  modified_base (329)..(329): a, c, t, g, unknown or other
  modified_base (417)..(417): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggcaggcccctgtgtggtgatgtataaagacactgagaggccctgagggatcccngagcgattcnctggctccgaggtcagggacaacgggtcacattggccaatcagttggagtccaggcagaggacgagctagactattatgtcaatcaanagacaccagttggtacttagtgtacttacggaactgaccgaacaaacggtcaccgtccgcgggtacacgcccgaacggccaaccccagtcgccacttccg

SEQ ID NO: 390395 - DNA, 521 bp, Homo sapiens
  misc_feature: GZ8MTXP02JZD1T.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgntatgcttattggtaccagcagaagccgggccaggcccctgtgttggtgatgtataaagacactgagaggccctgagggatccctgacgcgattcctcgtggctccgaggtcagggacaacggtcacattgccatcagtgagtccaggcagagacgagctgactattatgtacaatcaacagacactagttggtacttatgttcttacggaacttcgacgaccaacggtccaccgtccgcgggtaccacgcccgaacggcccaaccccgactcgtacactccg

SEQ ID NO: 390396 - DNA, 522 bp, Homo sapiens
  misc_feature: GZ8MTXP02F8TBN.52.86.H09.1.454.CMB.2.raw
  modified_base (239)..(239): a, c, t, g, unknown or other
  modified_base (425)..(425): a, c, t, g, unknown or other
  modified_base (445)..(445): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtacagcagaagccgggcaggccctgtgtggtgatgtataaagacactgagaggccctcgaggggactcccgtagagcgtattcctcgtggctccgaggtccaggggaccaacgggtcacattcggcagtcagtgagtccaggcagagtacgagctgactattatgtacatcaanagacaccattggtactagtntctcgtacgtcgcgacaacgtacgaccgtccgtcggtcgacgaaccgaacggaccgaacccaaccgtcgtcactccg

SEQ ID NO: 390397 - DNA, 640 bp, Homo sapiens
  misc_feature: GZ8MTXP02GDPNI.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagagggccctagaggggactccccgtgagcgtattcctcgtggctccgaggtcagggacaaacggtcacattggccagtcagtggagtccaggcaggaggacgaggctgacttattattgtacaatcaaacacgacacctagttaggtacttagtgtcgtttacggaaacttcggaccgtaaaccgtaacgggttacccgtaaaccccggttacccgttacgggggttaccccgtaaaccgggtaaccccccgtaaaaaaccccgggggtacccccctaaaaaaccccccccgtacgtttacccgggtttaccccgtaaacccgtttttccccccg

SEQ ID NO: 390398 - DNA, 738 bp, Homo sapiens
  misc_feature: GZ8MTXP02HATQE.52.86.H09.1.454.CMB.2.raw
  modified_base (216)..(216): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgactattcgaaccaaacgtatatcgtactttagttacggtaccagacgaaggaacggcccggaccgaccggtccccgttggttggttgggtagtagttagttaaacgtaaacgaccgtacgtaggaacggaccggtccccgtacggaacggggtaccttacccggtaggacggtacgtactttccgtccggtcggtccctaccggtacggtacggaacgggtaaccgtaccgggtaccaagttacggttacgaccctagtacggagggttacgggacgtacccggaagggacggaaggggtaaccggggaacggacggggtacttacggtaaactttagttagtttacggtaactaaacgtaacaaacgtacgaacctaacttagtttacggttactttagtcgttaccgttaacggacgtacggtaaccgaaccgtacggcccgtaaccggttccggtacggaccaccgaacccgaacggacccccaaccgtctacgtacctaccttacgttacccccg

SEQ ID NO: 390399 - DNA, 542 bp, Homo sapiens
  misc_feature: GZ8MTXP02GKYPD.52.86.H09.1.454.CMB.2.raw
  modified_base (239)..(239): a, c, t, g, unknown or other
  modified_base (288)..(288): a, c, t, g, unknown or other
  modified_base (447)..(447): a, c, t, g, unknown or other
  modified_base (526)..(526): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttattggtaccagcagaagccgggcacggcccctgtcgttggngatgtataaagacactgagaggccctgaggactcccgtgagcgtattcctacgtggcctaccgaggtcgaagggaccaacgggtcaaccgtagttcggacctaagtccaagtgacgtccgaggcaggagacgaggctagactattattgacaagtcaanacgacaacctagtagtactatgtctacgaactcgacgacaggtcacgtcgacggtcacgaacccgaagaccctaacccntcgaccacgttacccg

SEQ ID NO: 390400 - DNA, 486 bp, Homo sapiens
  misc_feature: GZ8MTXP02GOLL5.52.86.H09.1.454.CMB.2.raw
  modified_base (242)..(242): a, c, t, g, unknown or other
  modified_base (396)..(396): a, c, t, g, unknown or other
  modified_base (407)..(407): a, c, t, g, unknown or other
  modified_base (414)..(414): a, c, t, g, unknown or other
  modified_base (459)..(459): a, c, t, g, unknown or other
  modified_base (481)..(481): a, c, t, g, unknown or other
  modified_base (485)..(485): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggcccctgtgttggtgatgtataaagacactgagaggccctgagggatcccgtgagccgatctctggctccaggtcgagggacaacggtcacattggccatcagtgagtcagcagagacgagcngactatatgtnaatcaanagacacattgtacttatgtcttacggactgcacaaggtcacgtcnggtcacgccaacggccaacccnctcnc

SEQ ID NO: 390401 - DNA, 511 bp, Homo sapiens
  misc_feature: GZ8MTXP02FPJSW.52.86.H09.1.454.CMB.2.raw
  modified_base (275)..(275): a, c, t, g, unknown or other
  modified_base (416)..(416): a, c, t, g, unknown or other
  modified_base (418)..(418): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagcggccaggccctgtgtggngatgtataaagacactgagaggccctcgagggactcccgtgagcgtattctccgtggcctcgaggtcagggacacggtcacagttcggccatcagtggagtccaggcagaggacgaggctgactattattgtcaaatcaananacacattgtacttatgtctacgactgacgacaaaggtcaccgtcgtcgggtacacgacccaaggccccaaacccacgtctacacctcttcccg

SEQ ID NO: 390402 - DNA, 540 bp, Homo sapiens
  misc_feature: GZ8MTXP02IJSAR.52.86.H09.1.454.CMB.2.raw
  modified_base (239)..(239): a, c, t, g, unknown or other
  modified_base (408)..(408): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaacgntatgcttatggtacagcagaagccgggcaggcccctgtgtggtgatgtataaagacactgagaggccctcgagggactccctgagcgtattcctctggctccgaggtcagggcaacggtcacatcggcatcagtgagtcaggcagagacgaggctagactatattgtanaatcaacagaacaccattggtacttagtattcgttacggaaacttcggaccgaccaaacgggttccaaccgttccgtacgggtcaaccgaacccgaaacggccccaaaaccccgtctacgtaccacttcccg

SEQ ID NO: 390403 - DNA, 579 bp, Homo sapiens
  misc_feature: GZ8MTXP02IQZ5O.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgttggtgatgtataaagacactgagacggccctgagggactcccctgagcgtattcctctggctccgaggtccaggggacaacgggtcacgtattggccatcagtggagtccgaaggcaggaggacgaggctagactattattgacaatcaacagaaccacctagttaggtaactttagtgttactacgggtaacttcggaccgaccgtaaacgggtccaaccgttccgtacggggtacccaacggccccgaaaacgggccccctaaaacccccgacgtcggtaccaccctttacccg

SEQ ID NO: 390404 - DNA, 514 bp, Homo sapiens
  misc_feature: GZ8MTXP02GMKNF.52.86.H09.1.454.CMB.2.raw
  modified_base (478)..(478): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggcaggcccctgtgtggtgatgtaataaagcactgagaggccctgagggatcccgtgacgcgtattcctcgtgctccgaggtcagggccaacgggtcacgtattggaccatcgaagtggagtccaggcagaggacgagctgactattatgtacaatacaacagacacctattaggtacttagtgtcttaggaactgacgactaggcaccgtcncggtcacgccgacgccaacccatcgtaactcttccg

SEQ ID NO: 390405 - DNA, 600 bp, Homo sapiens
  misc_feature: GZ8MTXP02I9W2S.52.86.H09.1.454.CMB.2.raw
  modified_base (445)..(445): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagagccggcaggcccctgtgtggtgatgtataaagacactggagacggccctacgagggactccctaggacgccgattcctctgggcctccgaggtcgagggaacaacgtcacagttgacccatcgagtaggagtaccgaggcaggagacggagcgtagacgttattatagtacaatacaaacganaaccaccgtagttacggtactttaagtcgttacgttacggtaacgtacggaccgtaaccgaaacgggtttcccgaaacccgttccgttacggggtaaccaaaccggacccccgaaaaccggggccccaaaacccccggtacttccggttaacccc

SEQ ID NO: 390406 - DNA, 516 bp, Homo sapiens
  misc_feature: GZ8MTXP02HWAWY.52.86.H09.1.454.CMB.2.raw
  modified_base (241)..(241): a, c, t, g, unknown or other
  modified_base (312)..(312): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgctattggtaccagcagaagccggcaggcccctgtgttggtgatgtataaagacactgagaggccctnagggatccctgagccgattctctggctccgaggtcagggacaacggtcacattggccatcagtgagtccaggcagaggacgaggctgactattattgtacaatcaaacagaacaaccattggtaacttagtgtactttacggaaacttgacaccaaacggtccaccgtctgggtcacgcccaacggcccaacccactacgtacc

SEQ ID NO: 390407 - DNA, 501 bp, Homo sapiens
  misc_feature: GZ8MTXP02JQZSF.52.86.H09.1.454.CMB.2.raw
  modified_base (238)..(238): a, c, t, g, unknown or other
  modified_base (403)..(403): a, c, t, g, unknown or other
  modified_base (461)..(461): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgtggtgatgtataaagacactgagaggccctcagggatccctgagcgattcctctggctcaggtcagggacaacggtcacattgcatcagtggagtcaggcagagacgagctgactattattgtanaatacaacagacaccattggtaactatgtacttcgaactgcgtacaaggtcaccgtcngggtccagcccgaaggcccctaaccactcgtacaacttcc

SEQ ID NO: 390408 - DNA, 559 bp, Homo sapiens
  misc_feature: GZ8MTXP02G2AKY.52.86.H09.1.454.CMB.2.raw
  modified_base (227)..(227): a, c, t, g, unknown or other
  modified_base (244)..(244): a, c, t, g, unknown or other
  modified_base (328)..(328): a, c, t, g, unknown or other
  modified_base (430)..(430): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgganatgcattgaccaaacgntatgcttatggaccagcagaacgccggcacggcccctgtgttggtgatgtaataaagacactgagacggccctgagggactccngagccgtattctcgtggctacgaggtcgaagggacaacggtcactagttggccctatcgagtggacgtccaggcaggaggacgagctgactattaatcgtanaatacaacagacacgtagttacgtacttagtcgttacgttacggaaacctggaccgaaaccgtaaacggtccgtacccgtcgtcgggtccacgggaccccaacggaccccaaaccccgtactcgtaccc

SEQ ID NO: 390409 - DNA, 544 bp, Homo sapiens
  misc_feature: GZ8MTXP02GSV9H.52.86.H09.1.454.CMB.2.raw
  modified_base (238)..(238): a, c, t, g, unknown or other
  modified_base (324)..(324): a, c, t, g, unknown or other
  modified_base (427)..(427): a, c, t, g, unknown or other
  modified_base (430)..(430): a, c, t, g, unknown or other
  modified_base (438)..(438): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcacggccctgtgtggtgatgtaataaagacactgagacggccctagagggacttcccgngagcgtattccctcgtcggctccgaggtcgaagggaccaacggtcaacgtagttcggaccatcgagtgagtccgaggacagaggacgaggctagactattatntanaatacaanacaacacctagttacgtattatgtacttaggaactcgaccgtacgaacgtccaccgtcgtacggaccacgaaccgaacggacccaacccacgtctacctacttccc

SEQ ID NO: 390410 - DNA, 502 bp, Homo sapiens
  misc_feature: GZ8MTXP02GX3VS.52.86.H09.1.454.CMB.2.raw
  modified_base (242)..(242): a, c, t, g, unknown or other
  modified_base (402)..(402): a, c, t, g, unknown or other
  modified_base (415)..(415): a, c, t, g, unknown or other
  modified_base (422)..(422): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagagggccctgagggatccctgagcgattctctggctccgaggtcagggacaacggtcacagttggccatcaaggtgagtccaggcagagacgagcngactattatgtanatacaanagacaacattggtacttagtgtcttacggaactgcgacaagtccaccgtctggtcagacccacggccacccactcgtacc

SEQ ID NO: 390411 - DNA, 553 bp, Homo sapiens
  misc_feature: GZ8MTXP02F859F.52.86.H09.1.454.CMB.2.raw
  modified_base (238)..(238): a, c, t, g, unknown or other
  modified_base (429)..(429): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtggtgatgtataaagacactgagaggccctgagggactcccgtgacgcgtattccctcgtggctccgaggtcgaaggggaccaaacgggtcactagttcggccatcagtgacgtccgaggcagagacgagctgactattatgtacaatacaanagacaacctagttaggtacttatgttactacggaactcgacgaaccgtaaacggtccaaccggttcgtacggggtccaacgcccgaaacggaccccaaaccccgacttcggaccacgtttcccg

SEQ ID NO: 390412 - DNA, 606 bp, Homo sapiens
  misc_feature: GZ8MTXP02HPNI4.52.86.H09.1.454.CMB.2.raw
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtgtcccccaggacagacggccaggatcacctgctctggagatgcattgaccaaaccgntatgcttattggtaccagcagagccggcacggcccctgtgtggtgatgtaataaagacactgagacggccctgagggactccctagagcgtattcctcgtggctcgaggtcgagggacaacgggtcaacgtagttcggacctagtcgaggttgacgtccgaggcaggaggacgaggctagacttattagttgtacaagttcaacgtacgacaaccgtagttacggtacttagttcgtacctttacggaaacttcgacgtaaccgtaaacggtcctaacccggttccgacgggttaccaaccgaacccccgtaaaacggaccccctaaaacccccgtcgttaccggtacccttaacgtttcccccgg

SEQ ID NO: 390413 - DNA, 513 bp, Homo sapiens
  misc_feature: GZ8MTXP02JQYI8.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtaccagcagagcggcaggccctgtgtgtgatgtataaagacactgagaggccctgagggatccctgagcgattcctctggctcgaggtcagggcaacggtcacattggccatcagtgatccaggcagagacgaggctgactattatgtacaatcaacagacacctagttacggtacttatgttacttacggaactcgacgacacggtccaccggtccgtgggtccacgaacccgaacggcccaaaacccgctcgtaccacttccg

SEQ ID NO: 390414 - DNA, 617 bp, Homo sapiens
  misc_feature: GZ8MTXP02GDCNR.52.86.H09.1.454.CMB.2.raw
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctggtgttggtgatgtataaagacactgagaggccctgagggactccctgagcgtattcctctggctccgaggtcgagggacaacggtcacgtagttcggactatcgaagtggaacgtcccgagggcaaggaggaccggtaggctaggacttatttaagttgtactaaatacaaacagaccaacctattacggttaacttagtgttaccgttacggaaacgttcgaccgtaaaccgtaaacggtacccgtaacccggttccgtacggggttaccaaccggaaccccgaaacgggacccccaaaacccccggtacttccggtaccctacccgtttaccccg

SEQ ID NO: 390415 - DNA, 497 bp, Homo sapiens
  misc_feature: GZ8MTXP02FS9J2.52.86.H09.1.454.CMB.2.raw
  modified_base (489)..(490): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgtggtgatgtataaagacactgagacggccctgaggggactccctgagcgattccctctggctccgaggtcagggcaacggtcacattggccatcagtgagtcagcagagcgagctgactattatgtacaatcaaacagacacctagttggtacttagtgtacttcggaactgacgacaaggtcacgtcctaggcagccaggccaacccnncacactc

SEQ ID NO: 390416 - DNA, 611 bp, Homo sapiens
  misc_feature: GZ8MTXP02GJ731.52.86.H09.1.454.CMB.2.raw
  modified_base (223)..(223): a, c, t, g, unknown or other
  modified_base (241)..(241): a, c, t, g, unknown or other
  modified_base (279)..(279): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgntatgcttatgtacagcagagccggcacgccctgtgtgnatgtataagcatgagacggccctagagggctcccgtgacgcgtacttcctcgtcgcctccgacgggttaccgacggggacgtaacgggtcaacgtagttcggaccagtcgaagttggacgtacgaggacgaggaaggacggaggtctaggtaacttagtttagttacgtaacgtaacttaaccgaacgaacgtaacctaaccgtagtttacgggttaactttacgtacggttacgttaacggtacgttacggaccgtacgtaaacggtccaccgttcggtacggtcaaccgaacccgaacgacccaaccccgtagtcctacctacgttcccg

SEQ ID NO: 390417 - DNA, 681 bp, Homo sapiens
  misc_feature: GZ8MTXP02IZDXH.52.86.H09.1.454.CMB.2.raw
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtccgcaggctccaggcaaggggctgggagtggggtggcagttatatcccctatgatggaagcaatagcaactacgcaggacgtccggtaggaaacggggccgagttcggaccctaatccgtaccaaggaacgaacaaacgtaccggaaaagtaaagttaaccgggtttaccttacgttaaaccaaaagttcgaaaaccgacgtaccccgttagggaacggtaacggccgtaagggaacggggtaacccgaacgggggtacctttaaggtttacggtttttaaaccgtacgggtttcggaccggaaaggggtaaacgggggaaaccgtttaccggggaaattttaaccgaacggtaccgtaacggttacccccgttaaaacggg

SEQ ID NO: 390418 - DNA, 586 bp, Homo sapiens
  misc_feature: GZ8MTXP02HLGB1.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgacccaaacgnttatgcttattggtaccagcagaagccggcaggccctgtgtggtgatgtaataacgacacgtggagacggccctagagggtactcccgagacgcgtattccgtctggcctcgagtcgagggacacggtcactagtcgacatcgagtgacgtcgaggctaaggacggacgagctaggaactttagttagttgtactaacgtacaaacgtacgactaaccgtagttacggtacttagtacgttacgtacgtaacgtcgaccgtacgtaacggtccgtaccggtcgtacggggttaccacggaaccccgaacggacccctaaacccgtcttacgaccttacgttcccg

SEQ ID NO: 390419 - DNA, 565 bp, Homo sapiens
  misc_feature: GZ8MTXP02GX63Y.52.86.H09.1.454.CMB.2.raw
  modified_base (241)..(241): a, c, t, g, unknown or other
  modified_base (443)..(443): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccaggcccctgtgtggtgatgtataaagacactgagacggccctgacgggatcccctggacgccgtattctcgtggcctccgagggtcgagggacaacggtcacagttggcatcgtaggtggacgtccgaggacaggaggacgaggctggaacttattattcgtacatacaaanacgaccacctattacggtacttagtgttacttacgggaactggaccgaaccgaaaggtccaacccggtccgtacggggtaaccacggacccctaacggccccaaaccctacgtacgtacccg

SEQ ID NO: 390420 - DNA, 526 bp, Homo sapiens
  misc_feature: GZ8MTXP02J11OK.52.86.H09.1.454.CMB.2.raw
  modified_base (242)..(242): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcgagggactcccgtgagccgattctctggctccgaggtcagggacaacggtcacattggccatcagtggagtccaggcagaggacgaggctgactattatgtacaatcaaacagaccaacctagtttcggtactttatcgttcttacggaactggaccgacaaggtccaccgtccgtgggtcacgacccaacggcccaacccgacttcgacc

SEQ ID NO: 390421 - DNA, 531 bp, Homo sapiens
  misc_feature: GZ8MTXP02F22UG.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagacggccctgagggacttcccgtgagcgtattcctcgtggctccgaggtcgagggacaacgggtcacgtattgggaccatcgagtggagtcccgaggcgaagaggacgaggctgactattattgtacaatcaacagacacctattggtacttatgtcttacgactcgacgacacggtccacgtccgtacgggtcacgcccgaacggcccaacccgctcgacactccg

SEQ ID NO: 390422 - DNA, 547 bp, Homo sapiens
  misc_feature: GZ8MTXP02I82GJ.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtgtgatgtataaagcactgagaggccctgagggatcccgtgagcgtattcctctggctccgaggtccgagggacaacgggtcactagttcggccatcgagtggatccgaggcagaggacgaggctgactattatgtacaatcaacagtaaccacctagttggtacttatcgtacttacggaacttcgacgaccgtaaacgggtccaaccggttccgtacggggtccacggccccgaagggccccaaaccccgactcgtaccactttcccg

SEQ ID NO: 390423 - DNA, 580 bp, Homo sapiens
  misc_feature: GZ8MTXP02I1LI3.52.86.H09.1.454.CMB.2.raw
  modified_base (237)..(237): a, c, t, g, unknown or other
  modified_base (324)..(324): a, c, t, g, unknown or other
  modified_base (427)..(427): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagagccggccggccctgtgtggtgatgtataaagcactgagaggccctgagggactccctgagcgattcnccgtgctcgaggtcagggacacgggtcacgtagttcggcctaatcgaggtggacgtccgagggacaggagacgaggctggacttattattgactaagtcaaanagacaacctagttaggttaacttagtacgttccgttacgggaaacttcggaccgaacctaaagggtccctaaaccggttccgttacggggtaccacggacccccgaaacgggcccccaaacccgtacgtcgtaccctacttccgtttaccccg

SEQ ID NO: 390424 - DNA, 508 bp, Homo sapiens
  misc_feature: GZ8MTXP02FPRPU.52.86.H09.1.454.CMB.2.raw
  modified_base (239)..(239): a, c, t, g, unknown or other
  modified_base (313)..(313): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctnagggatccctgagcgattcctctggctccaggtcagggcaacggtcacattggccatcagtggagtccaggcagagacgaggctgactattattgcaatcaaacagacaccattggtacttatgtacttcggaaactgacgaccaaaggtcaaccgtctgggtcagcccaaggccaaccccgatcgtcacttccg

SEQ ID NO: 390425 - DNA, 522 bp, Homo sapiens
  misc_feature: GZ8MTXP02HOUXG.52.86.H09.1.454.CMB.2.raw
  modified_base (240)..(240): a, c, t, g, unknown or other
  modified_base (336)..(336): a, c, t, g, unknown or other
  modified_base (442)..(442): a, c, t, g, unknown or other
tcagcgcagtacgacacgaccggtgctcgatttagtgctatagacttgggtttgggggtgggtccaggaggcaggaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtcgttggtgatgtataaagacactgagaggccctgagggatccctgagcgattccnctggctccgaggtccagggcaacggtcacattcggcatcagtgagtccaggcagagacgaggctgactattattgtacaattcaacagacaccgaatggtacttangttcttacggaactgcgacaaacggtcaaccgtccgagggtcacgaacccgaacggcccaaaccccacgtcgactactcg

SEQ ID NO: 390426 - DNA, 597 bp, Homo sapiens
  misc_feature: GZ8MTXP02JNTR3.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgtggtgatgtataaagacactgagacggccctgagggatcccgtgagcgtattcctctggctcgaggtcagggacaacggtcacattggcatcagtgagtccaggcagagcgaggctagactattatgtacaatcaaacagaaccacctagttaggttaactttaagtcggttaccgtttacgggaaaactttcggaccgaacccgtaaaacgggtcctaaacccggttacccgtcgggggttacccaaccgggaacccccgaaacggggaacccccaaaacccccggtacttccggtaccctaacccgtttcccg

SEQ ID NO: 390427 - DNA, 524 bp, Homo sapiens
  misc_feature: GZ8MTXP02GDMUI.52.86.H09.1.454.CMB.2.raw
  modified_base (223)..(223): a, c, t, g, unknown or other
  modified_base (266)..(266): a, c, t, g, unknown or other
  modified_base (284)..(284): a, c, t, g, unknown or other
  modified_base (287)..(287): a, c, t, g, unknown or other
  modified_base (330)..(330): a, c, t, g, unknown or other
tcagcgcagtacgacacgaccggtgctcgatttagtgctatagacttgggtttgggcacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtntcagtgtccccaggacagacggccaggatcacctgctctgganatgcattgaccaaaccgntangcttattggtaccagcagaagccggccaggcccctgtgttggngatgtataaagcactgagacgccctgagggactcccgtgacgtcgattctcgtggctaccgaggtcgagggaccaacggtcacattcggaccatcgagtgacgtccgagcagaggacgaggctagactattatgtacaatacaacacgaccactagttcggtacttagtacgtcgttacggaacttggaacccg

SEQ ID NO: 390428 - DNA, 554 bp, Homo sapiens
  misc_feature: GZ8MTXP02GBLU0.52.86.H09.1.454.CMB.2.raw
  modified_base (239)..(239): a, c, t, g, unknown or other
  modified_base (541)..(541): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttagttggtacagcagaagccgggcacggccctgtgttggtgatgtaataaagacacgtgagcggccctgagggactccctgagcgattcctcgtcgctccgaggtcacggggaccaacgggtcacgtagttcggaccagtcgagtggacgtccgaggcaggaggacgaggctgactattagttgactaatacaacagaacaaccgtagttacggttacttattcgtacgtttacggaacttcgaccgtaaccgaaacgtccaccgtcgtacggtcacgccgaacgaccaaaccccncgtactacactcg

SEQ ID NO: 390429 - DNA, 497 bp, Homo sapiens
  misc_feature: GZ8MTXP02IIF59.52.86.H09.1.454.CMB.2.raw
  modified_base (242)..(242): a, c, t, g, unknown or other
  modified_base (316)..(316): a, c, t, g, unknown or other
  modified_base (439)..(439): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggcaggcccctgtgttggtgatgtataaaagcactgagaggcccctnagggatccctgagccgattctctggctccaggtcagggacaacggtcacattgccatcagtgagtccagcagaggcgaagggctgaactagttattgtacaatcaacagacacattgacttangtacttcggaactgctaacaagtcacgtcaggtcagccaaggccaacccgactcgtac

SEQ ID NO: 390430 - DNA, 541 bp, Homo sapiens
  misc_feature: GZ8MTXP02I70ID.52.86.H09.1.454.CMB.2.raw
  modified_base (238)..(238): a, c, t, g, unknown or other
  modified_base (282)..(282): a, c, t, g, unknown or other
  modified_base (361)..(361): a, c, t, g, unknown or other
  modified_base (418)..(418): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggngatgataaagacactgagaggccctgagggactcccgtgagcgtattcctctggctccgaggtccagggcaacggtcanagttggccatcagtggagtccaggcagaggacgaggctagactattattgtacaatnaaacagacaaccagttaggtacttaatagtacgttacgtaacgtacgacgaaccgtaacgtacgtaaccgtccgtacggtcgacgaaccgaacggaccgaacccaaccgtacgtctacttccg

SEQ ID NO: 390431 - DNA, 512 bp, Homo sapiens
  misc_feature: GZ8MTXP02HDEPT.52.86.H09.1.454.CMB.2.raw
  modified_base (430)..(430): a, c, t, g, unknown or other
  modified_base (477)..(477): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggccaggccctgtgtggtgatgtaataaagacactgagacggcctagagggactcccgtgagcgtattcctcgtggctcgaggtcgagggacaacgggtcaactattggaccatcagtcggagtccgaggcaagaggacgaggctgactattatgtacaatacaanagacactagtagttactatgtctagaactgaccacgaagtcacgtcnggtcacgcccaggacccacccgatcgacctactcc

SEQ ID NO: 390432 - DNA, 525 bp, Homo sapiens
  misc_feature: GZ8MTXP02J0M6N.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtacagcagaagccggccaggcccctgtgttggtgatgtataaagacactgagaggccctgagggactccctgagcgattcctctggctcaggtcgagggcaacggtcacatgcatcagtgagtccaggcagaggacgaggctgactattacttgtacaatcaacagacctaccagttaggtacttatgttacttacggaactcgacgtaccgaacggttccaccgtccgtcgggtaccacgaacccgaacggacccaaccccgatcgtacactcccg

SEQ ID NO: 390433 - DNA, 608 bp, Homo sapiens
  misc_feature: GZ8MTXP02H3T9L.52.86.H09.1.454.CMB.2.raw
  modified_base (235)..(235): a, c, t, g, unknown or other
  modified_base (251)..(251): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtcccaggacagacgccaggatcacctgctctggagatgcattgccaaacgntatgcttatggtaccngcagaagccggccaggccctgtgttggtgatgtataaagacactgagacggccctgagggactcccgtgagcgtattccctcgttggctccgaggttccgaaggggaccaaacgggttcaacctagttcggacccatccagtggaagtcccgagggccgaagagggaccggaaggcctaggtacttattaagttcgttacaaattacaaacaggaacctaaccgtaattacggtaacttaagtgttacgtttacgggaaacttcggacgtaaccgtaaacggttccgaacccgttccgtacggggtaccaacggccccgaaaggaccccaaaccccagtccgtaccaaccgtttccc

SEQ ID NO: 390434 - DNA, 500 bp, Homo sapiens
  misc_feature: GZ8MTXP02F09P4.52.86.H09.1.454.CMB.2.raw
  modified_base (238)..(238): a, c, t, g, unknown or other
  modified_base (310)..(310): a, c, t, g, unknown or other
  modified_base (438)..(438): a, c, t, g, unknown or other
  modified_base (448)..(448): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgtggtgatgtataaagacactgagaggccctnagggatcccctgagcgattcctctggctccaggtcagggcaacgggtcacattggccatcagtggagtccaggcagaggacgaggctgactattattgcaatcaacagacagtagtggttactagtgngcagttcggnggagggaccaagctgaccgtcgtaggtcacgcccaggctcgcccctggtacc

SEQ ID NO: 390435 - DNA, 532 bp, Homo sapiens
  misc_feature: GZ8MTXP02FM99B.52.86.H09.1.454.CMB.2.raw
  modified_base (241)..(241): a, c, t, g, unknown or other
  modified_base (426)..(426): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggtgatgtataaagacactgagaggccctgagggactccctgagccgattctctggctccgaggtcgagggacaacggtcactagttcggccatcaggtgagtccgaggcaggaggacgaggctgactattactgtacaatcaanagacaccattggacttagtgtcttacggaactgaccgaacgaaacggtctacccgtcgtcggggtaacacggaccccaacggccccaaaccccgacgtcgtaaccc

SEQ ID NO: 390436 - DNA, 609 bp, Homo sapiens
  misc_feature: GZ8MTXP02GJKZE.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccaggcccctgtgttggtgatgtaataaagacactgagacggccctgagggtactcccgtgacgtcgtattccctcgtggcctccgagggtaccgaaggggaccgtaacgggtcaacgtagttcgggaccctagtcgaggtggacgtaccgagggacaaggagggacgaaggtcctagtaacttaagttattgtacaactacaaactagaacaacctagttcggttacttagtgttacgttacgaactggaccgaaccgaaaggtccctaaccgtccgtacggggtaccacggaaccccgaacggaccccaaaacccctacgtcgtacctacctttccg

SEQ ID NO: 390437 - DNA, 571 bp, Homo sapiens
  misc_feature: GZ8MTXP02GVDZD.52.86.H09.1.454.CMB.2.raw
  modified_base (240)..(240): a, c, t, g, unknown or other
  modified_base (346)..(346): a, c, t, g, unknown or other
  modified_base (413)..(413): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagagccggcacggcccctgtgtggtgatgtataaagacactgagacggccctgagggactcccgtgacgcgtattcctcgtgctccgnggtcgaggggacctaaacgggtcactagttcggaccatcagtggacgtccgaaggcgaagaggacgnggcgtagacttatttagttgtactaactcaaacagtaaccacctagtttagtactttaagtcgttactacgggaacttcggacgtaccgtaaacgggtccaacccggttcgtcgggtacacgaacccgaacggacccaaccccatcgtcactttcccg

SEQ ID NO: 390438 - DNA, 512 bp, Homo sapiens
  misc_feature: GZ8MTXP02HCLHO.52.86.H09.1.454.CMB.2.raw
  modified_base (239)..(239): a, c, t, g, unknown or other
  modified_base (282)..(282): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgtggngatgtataaagcactgagaggccctcgaggggactccccgtgagcgtattccctcgtggctccaggtcaggggacaacggtcacgagttcggcatcgagtggacgtccgaggcagaggacgaggctgactattagtgtacatacaacagaccacattggtacttatgtctagactgacgacaggtccacgtctacggtcacgcccgaaggcccaacccgatcgtcactcc

SEQ ID NO: 390439 - DNA, 481 bp, Homo sapiens
  misc_feature: GZ8MTXP02FH3G3.52.86.H09.1.454.CMB.2.raw
  modified_base (237)..(237): a, c, t, g, unknown or other
  modified_base (283)..(283): a, c, t, g, unknown or other
  modified_base (310)..(310): a, c, t, g, unknown or other
  modified_base (357)..(357): a, c, t, g, unknown or other
  modified_base (429)..(429): a, c, t, g, unknown or other
tcagcgcagtacgacacgaccggtgctcgatttagtgctatagacttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgctattggtaccagcagaagccgggccaggcccctgtgttggngatgtataaagacactgagaggccctnagggatccctgagcgatccctctggctcaggtcagggcaacggtcanattgccatcagtgagtcaggcagaggacgaggctgactattatgcaagtcaacagacaccattggtacttangtcttggaactgcacaaggtcacgtctggcagccagccaaccatcgcactcg

SEQ ID NO: 390440 - DNA, 516 bp, Homo sapiens
  misc_feature: GZ8MTXP02FZW80.52.86.H09.1.454.CMB.2.raw
  modified_base (239)..(239): a, c, t, g, unknown or other
  modified_base (505)..(505): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagacggccctcgagggatcccgtgagcgattcctctggctccgaggtcagggcaacgggtcacattggacatcagtggagtccgaggcagaggacgaggctagactattattgtacaatcaacagacacctagttgtacttatgtacttcgaactcgacgaccaggtccaccgtcgtcgggtcacgcccgaaggcccaacccngtcgcactccg

SEQ ID NO: 390441 - DNA, 501 bp, Homo sapiens
  misc_feature: GZ8MTXP02FHYDO.52.86.H09.1.454.CMB.2.raw
  modified_base (324)..(324): a, c, t, g, unknown or other
  modified_base (428)..(428): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgtggtgatgtataaagacactgagaggccctcagggatcccgtgagcgattcncctggctcaggtcagggacacgggtcacattgccatcagtgagtccaggcagaggacagggctagactattattgtcaatcaacagacacatggtacttatgtntcggaactgcgaccaaggtccaccgtcctcggggtccagcccaaggccctaaccccactacgtcactctcccg

SEQ ID NO: 390442 - DNA, 584 bp, Homo sapiens
  misc_feature: GZ8MTXP02JY6QL.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagagccggcaggccctgtgtggtgatgtataaagcactgagacggccctagagggtactcccgtagacgcgtattcctcgtggctccgaggtcgagggacaacgggtcaactagttcggaccagtccgaggtggacgtcccgagggccaggagggacgaggctaggacttattagttgtacaagtacaaacgacgaaccaacctagtttaggtacttagtcgttcttacggaacttcggaccgaaccgaacggtccaacccggttcgtacggtaccacgaacccgaaacggcccctaaacccgctccgtaccaccgtttccccg

SEQ ID NO: 390443 - DNA, 608 bp, Homo sapiens
  misc_feature: GZ8MTXP02I4PHZ.52.86.H09.1.454.CMB.2.raw
  modified_base (223)..(223): a, c, t, g, unknown or other
  modified_base (240)..(240): a, c, t, g, unknown or other
  modified_base (287)..(287): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatccacctgctctgganatgcattgaccaaacgntatgcttagtgtaccagacagaacgccggccacggccctgtgtggtnatagtataaagacactagagacggccctagagggtactcccgtgacgacgtattcccgtcgtcggtcctaccggtaggtacggaacgggtaccgtaacgggtaccaacgtacgttccggacctattaccggaaggttggacgttacccgaggacgaagggacggacggtacggacgtagtaacttaagtttacgttacgtaactaaacgtacaaacgtacgaactacgtagttacgttactagtcgtacgtacgaactcgacgacgacggtcctaccgtcgtacgcacgaaccgacgacccaccgactcgtccgacttccg

SEQ ID NO: 390444 - DNA, 569 bp, Homo sapiens
  misc_feature: GZ8MTXP02HF2HT.52.86.H09.1.454.CMB.2.raw
  modified_base (433)..(433): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcaggcccctgtgtggtgatgtaataaagacactgagacggccctgagggactcccgtgagcgtattcccgtcgtggcctccgaggtcgaggggacaacgggtcactagttggccatcagtgacgtccgaggcagaggacgaggctgactattagtgtacaatcaanagaccaactagttaggtactttatcgtacgtttacggaacttacggacgaccgtaaacggtccaacccggttccgtaggggtccacggaaccccgaaacggccccaaaacccccgtctacggtacctactttcccg

SEQ ID NO: 390445 - DNA, 515 bp, Homo sapiens
  misc_feature: GZ8MTXP02GJ2J7.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtactagcagaagccggcaggcccctgtgttggtgatgtataaagacactgagaggccctgagggatcccgtgagcgtattcctctggctcgaggtcaggggcaacggtcacagttcgaccatcagtggacgtccgaggcaagacggagaggctagactatttagttgtacaagtcaaacagaactaccagttaggtacttatgtcttacgactgcgacagtcacgtcgtggtcacgccaacggcccaaccactcgtacactccg

SEQ ID NO: 390446 - DNA, 558 bp, Homo sapiens
  misc_feature: GZ8MTXP02GALSX.52.86.H09.1.454.CMB.2.raw
  modified_base (536)..(536): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgataaagacactgagaggccctcgagggactccctgagcgtattcctctggctccgaggtcagggacaacggtcacagttgccatcagtgagtccaggcagagacgaggctgactagttatgtacaatcaaacagaacacctaagttggtacttaatgtacttacggaaacttcgacgaacctaaacggtccaaccggttcccgttaggggaccaacggccccgtaaacgggaccccaaaacccccgngttaccgtaccaccgtttcccg

SEQ ID NO: 390447 - DNA, 564 bp, Homo sapiens
  misc_feature: GZ8MTXP02J18Z0.52.86.H09.1.454.CMB.2.raw
  modified_base (237)..(237): a, c, t, g, unknown or other
  modified_base (345)..(345): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcaaacgntatgcttatggtaccagcagaagccgggccaggcccctgtcgttggtgatgtataaagacactgagaggcccctgagggactcccgtgagcgattcctctggctccgnggtcgagggcacggtcacagttggccatcagtggagtcccaggcagagggacgagctgactattattgacaatcaacagacaccagttggtacttagtcgttacttacgggaaacttcggaccgaaccgtaaacgggtccctaacccggttccgtacgggtaccgaaccggccccgaaacgggaccccaaaccccggtactcggtacctacctttcccg

SEQ ID NO: 390448 - DNA, 610 bp, Homo sapiens
  misc_feature: GZ8MTXP02IIP4B.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctcccccctcctcactctctgcacaggctctgaggcctcctatgagctgacacagcccaccctcggtgtcagtgtcccccaggacagacggccaggatcacctgctctggagatgcattcgaccaaaaccgatatgtcttattggtaccagcagaacgccgggcacggcccctgtgtggtgatgtaataaagacacgtgagacggccctagagggactcccgtagagcgtattcctcgtggctccgaggtcgaagggacgaacggtcaacgtagttcggaccatccgagtggacgtaccgaggacgaaggagggacggaagggtctagtaacttagtttagttcgtaactaaactacaaacgagaaccaccgtaagtttacggtatttaagtgttcgttacgaacttcgaccgaacctaaacggttccaaccggttccgtacgggtacaacggaacccgaaacggaccccaaacccgtactccgtaccaccttcccg

SEQ ID NO: 390449 - DNA, 607 bp, Homo sapiens
  misc_feature: GZ8MTXP02HWU4J.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtcccccaggacagacggccaggatccacctgctctggagatgcattgaccaaaccgatatgcttattggtaccagcagaacgccgggccacggcccctgtgttggtgatgtaataaagacacgtgagacggccctacgagggactcccgtgacgtcgtattcctcgtcggcctaccgaggtaccgagggaccgtaacggtcacgtagttcggaccagtcagtggacgtccgaggcgaagacgggacggaggcgtagacttatttagttcgtaactaaattacaaaactacgaacctaactagttaggttaacttagttcgttacgtttaacgaaacttcgaccggtaaaccaacggtcctaccgtccgtacggtacgacgaaccccgaaacgacccctaaacccatccgactacgtccg

SEQ ID NO: 390450 - DNA, 664 bp, Homo sapiens
  misc_feature: GZ8MTXP02JVZ1K.52.86.H09.1.454.CMB.2.raw
  modified_base (222)..(222): a, c, t, g, unknown or other
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgganatgcattcgaccaaacgntatgcttatgtaccagcagaagccggcaggccctgtgtggtgatgtaataagacacgtgaggacggccctagagggtactcccgtagagcgtattcccgtcgtggcttacgaacggccgtaaggggacgaaacgggtctaacgagttacggccagttcgaagttcgggaaagttcccgagggaccgaagggacgggtaccggaaagggtccgtagggtaacctttaaatttcggtttaggttaccctaaaacaaccgtaaacgacgaaacctaccgttagtttaacggttaactttacgtacggtttaccgttacgggtaacttcggaaccgtaaccgacggttacccgtaccggtaccgtacgggtacccaaccggtaacccgaaccggacccctaaacccgtcgtaccgtacctaccgtccg

SEQ ID NO: 390451 - DNA, 529 bp, Homo sapiens
  misc_feature: GZ8MTXP02I8E4I.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccaggcccctgtgttggtgatgtataaagacactgagaggccctcgagggactccctgacgcgtattcctctggctcgaggtcgagggacacgggtcacgattcggccatcagtgagtccaggcagagacgaggctagactattagttgtacaatcaacagaacacctattggtaactttatgttacttcggaacttcgacgacaacggtccaccgtccgtcggtcacgaacccgaacggcccaacccatcgtacacgttccg

SEQ ID NO: 390452 - DNA, 508 bp, Homo sapiens
  misc_feature: GZ8MTXP02J0P31.52.86.H09.1.454.CMB.2.raw
  modified_base (238)..(238): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtggtgatgtataaagcactgagaggccctgagggactcccgtgagcgtattccctcgtggcctccaggtccaggggaccaacgggtcacattggccatcagtggagtcgaggcagagacgaggctgactattatgcaatcaacagacaccattggacttatgtcttacggaactgacgacaacggtccaccgtcgtcggtcacgcccaaggcccaacccactcgtcactccg

SEQ ID NO: 390453 - DNA, 608 bp, Homo sapiens
  misc_feature: GZ8MTXP02H2O89.52.86.H09.1.454.CMB.2.raw
  modified_base (220)..(220): a, c, t, g, unknown or other
  modified_base (238)..(238): a, c, t, g, unknown or other
  modified_base (278)..(278): a, c, t, g, unknown or other
  modified_base (444)..(444): a, c, t, g, unknown or other
  modified_base (446)..(446): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacgccaggatcacctgctctgganatgcattcgaccaaacgntatgcttatggtaccagcagagccggcaggccctgtgtgngtatgtaataagacactagagacggcccctagagggactccgagtacgcgtatcctcgtcgcctcgaggtacgaacgggacctaacgggtacactacgttcggcctaatcgagtggacgtccgaggacgagaggacgaggacagtattattagtgtacaatacaananacactagttcggtaactagttcgtagttacggaaaactcggaacccgtaacgtaaacggtcccgtaaaccgttaccggttcggggtaaccaaccggtaaccccgaaaccggggtaacccccaaaaccccctaacgtcccggtacctaaacccgtttcccccg

SEQ ID NO: 390454 - DNA, 564 bp, Homo sapiens
  misc_feature: GZ8MTXP02JNGC0.52.86.H09.1.454.CMB.2.raw
  modified_base (208)..(208): a, c, t, g, unknown or other
  modified_base (279)..(279): a, c, t, g, unknown or other
  modified_base (420)..(420): a, c, t, g, unknown or other
  modified_base (550)..(550): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggancacctgctctggagatgcattcgaccaaacgatatgcttatggtacagcagaagccggcagccctgtgtgngatgtataaagacacgtagaggacgccctagacgggactcccgtagacgcgtattcccgtcgtcggctccgaggtaccgaagggaccgaaacggtcacgtagttcgaccatcgagtgacgtcgaggcagagacgagcgtanacgttattattgtaacaatcaaacacgaactactaagttcggtaacttatacgttcttaacggaacttcggaccgaacgtacggtacgtaccgtccgtacgggcacgaacccgaacgaccccaaaacccncgtactcctactcc

SEQ ID NO: 390455 - DNA, 695 bp, Homo sapiens
  misc_feature: GZ8MTXP02GNYFT.52.86.H09.1.454.CMB.2.raw
  modified_base (239)..(239): a, c, t, g, unknown or other
  modified_base (284)..(284): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaacgccggcacggccctgtgtggtnatgtaataaagacactgagcggccctagagggactccctagagcgtattccctcgtcggccttccgaggtccgaaggggaccgtaacgggtacaacgtagttcgggacctaagttcaaggttgggaacgtcccgaaggccgaaaggggacggaccggtaaagggccgttaggaaacctttaagtttatttcggtaaactaaaacttaccaaaacgtacggaaacctaacccgttaagtttacgggttaaaccctttaaaggttccgttaaccgttttaccggaaaacgttcggaacccggtaaaaccgtaaacggtacccgtaaacccgtccggtttacgggacccgaaaccgaaccccgaaaaccgggcccccaaaaccccgtcttaacggtcccctaacgtttcccccg

SEQ ID NO: 390456 - DNA, 649 bp, Homo sapiens
  misc_feature: GZ8MTXP02G7M20.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggatccacctgctcgtggagatgctattcgacccaaacgtatatgtacttatggtaccagacagacgccggcacggccctgtgtgtagatagtaataaagacagtagagacgccctagagggtactcccgtagacgcgtacttcccgtcgtcgctaccggaggtacgaacgggacctaacgggtcaacgtagttacggacctagtacgtaggtacggaacgtacccgagggacgaagggtaacgggacggacggtaccgttaaggtaaacttaagtttattacggtaactaaacttaccaaaacgtacgaaacctaaccgtaagtttacggttaacttagttcgttacgtacgtaacgtacgtaccgaacgtacgtccgtaccggtcgttacggacacgaacccgaacggaacccctaccgtacgtcgtaccctacgttccccg

SEQ ID NO: 390457 - DNA, 668 bp, Homo sapiens
  misc_feature: GZ8MTXP02F1BD2.52.86.H09.1.454.CMB.2.raw
  modified_base (238)..(238): a, c, t, g, unknown or other
  modified_base (285)..(285): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggngatgtataaagacactgagtacggcccctgagggactcccgtgacgcgtattccctcgtcggcctaccgtaggtaccgaaggggaccaaaccgggtaccaacgtaacgtttcggaccctataccgaaaggttggaaccgtcccgaaggacgtaagggaaacggtaccggaaaggggccttacgggaaacgtttaagtttaaatttcggtaaacaaaacgttaccgaaaacaacgggaaccctaaaccctagtttagggttaacctttaagttcgtacgtttacgggaaaacttcggaccgtaaaccgtagggtaccctaacgtccgttacgggccaacggcccgaaaacggacccaaaacccgcgttaaccgacctacgtccg

SEQ ID NO: 390458 - DNA, 550 bp, Homo sapiens
  misc_feature: GZ8MTXP02JM31N.52.86.H09.1.454.CMB.2.raw
  modified_base (238)..(238): a, c, t, g, unknown or other
  modified_base (254)..(254): a, c, t, g, unknown or other
  modified_base (272)..(272): a, c, t, g, unknown or other
  modified_base (329)..(329): a, c, t, g, unknown or other
  modified_base (420)..(420): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccngcagagccggcaggcccngtgtggtgatgtataaagacatgagacggccctgagggactcccgtgagcgattccncgtggctccgaggtcgagggacaacgggtcacgtagttggcatcgaagtggaacgtccaggcaaggagacgtaggctgactattagtgtanaattacaaacagaacaacctagttacgttacttagtgtacttacggaacttcggacgtaccgaaaggtccaccggttccgtacggggtcacggaaccgaacggacccaaccccgagttcactaccttccg

SEQ ID NO: 390459 - DNA, 502 bp, Homo sapiens
  misc_feature: GZ8MTXP02JGPTM.52.86.H09.1.454.CMB.2.raw
  modified_base (237)..(237): a, c, t, g, unknown or other
  modified_base (413)..(413): a, c, t, g, unknown or other
  modified_base (465)..(465): a, c, t, g, unknown or other
  modified_base (491)..(491): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtataaagcactgagaggcctacgagggatcccgtgacgcgtattcctctggctccgaggtcagggacacggtcacattggcatcagtgagtcgagcagagacgagctgactattatgcaatcaaanagacaccattggtacttatgtcttagaactgacgacaacgtcaaccgtccgnggtcacgccgaacggccaaacccctntcgtacactcg

SEQ ID NO: 390460 - DNA, 612 bp, Homo sapiens
  misc_feature: GZ8MTXP02GHAQ8.52.86.H09.1.454.CMB.2.raw
  modified_base (240)..(240): a, c, t, g, unknown or other
  modified_base (283)..(283): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgacttatggtaccagcagaagccggccaggccctgtgtgngatgtaataaagcagtgagacggccctagagggactcccgtgacgcgtattccgtcgtggctaccgaggtcgaacggggacaacgggtcaacgtagttcggacctaagtccaaggttcggacgtcgaggcgaaggaggaccgaggtctagtaccttagtttagtgtaacaattacgaaactagaacctaccgtaagttcggtaactttatcggtacgtttacggaaacttgaccgtaaacgtacggtaccgacccgttcgtacggggtacaaccggtaaccccgaaacggcccccaaaaccccgtcgttacgtacctaaccgtttcccg

SEQ ID NO: 390461 - DNA, 583 bp, Homo sapiens
  misc_feature: GZ8MTXP02HPBAD.52.86.H09.1.454.CMB.2.raw
  modified_base (242)..(242): a, c, t, g, unknown or other
  modified_base (323)..(323): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgacccaaaccgntatgcttatggtaccagcagagccggccaggccctgtgtggtgatgtataagacacgtgagacggcctgagggactcccgngagcgtacttccctacgtgctccgaggtccgaagggaccaacggtcaactgttggtacatcgagtggacgtcgaggcagacggacgtagctagacttattagttagtactaaatacaacacgacaccgtagttacggttacttagtcgttacgttacgaacttcggaccgaacgtaacgggtccctaacggtcccgtacggtccaaccggaaccccgaaacggtacccccaaacccgtactacgtaccctactttccccg

SEQ ID NO: 390462 - DNA, 519 bp, Homo sapiens
  misc_feature: GZ8MTXP02I5QON.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgtggtgatgtataaagcactgagaggccctacgagggactcccctgagcgtattcctctggctcaggtcagggcaacggtcacagttggccatcagtggagtccaaggcagaggacgaggctagactattagtgtacaatcaacagtacacctattggtacttatgttactcggaactgacgaccaaggtccaccgtcgtcggtcacgcccgaacggcccaacccgatcgtcacgttccg

SEQ ID NO: 390463 - DNA, 726 bp, Homo sapiens
  misc_feature: GZ8MTXP02F6MBN.52.86.H09.1.454.CMB.2.raw
  modified_base (244)..(244): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaaccgntatgtacttagttcggtaccagacaggaacggccgggccgacggccccgtgtggttggtagatgtaataaagacactggagacggccctgagggtactcccgtagacgcgtattccctcgtcggcctaccgtacggtacgacggggaccgtaacgggtcaacgtacgttcggacctagtacgtagggtggacgtaccgaggaccaagggaacggaccggaggccgttagaaacgttaagtttagttacgtaacaacttaccgaaacaacggaacctaaccgttaagtttacgggttaactttaacgttcgtttaccggtttaaccggtaacgttacggtaacccggtaaaccgtaaaccgggtttacccgtaaaccccggttcccgggttaacggggttacccgaacccggtaaccccggaaaacccgggaaccccctaaaaccccgtccgtttaccggtacccttacccgtttcccccggg

SEQ ID NO: 390464 - DNA, 572 bp, Homo sapiens
  misc_feature: GZ8MTXP02IFS40.52.86.H09.1.454.CMB.2.raw
  modified_base (380)..(380): a, c, t, g, unknown or other
  modified_base (425)..(425): a, c, t, g, unknown or other
  modified_base (453)..(453): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgacccaaacgtatatgtcttagttggtaccagcagaacgccggcacggccctgtgttggtgatgtaataaagacactgagacgccctagagggtactcccgtgacgcgtacttcctcgtcggcctccgaggtcgaacgggacacggtnactagttcggactatacgagtgagtccgaggacgaagacggacgnggctagtactattagttgacaatacaanagacacgtagtttacgtattatgtcgtacgactcgacgtaccgacgtaccgaccgtccgtacggtaccaaccggtaacccgaaaccggacccaacccctactccgtacctaccttcccg

SEQ ID NO: 390465 - DNA, 610 bp, Homo sapiens
  misc_feature: GZ8MTXP02ICYQY.52.86.H09.1.454.CMB.2.raw
  modified_base (243)..(243): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctctatgagctgacacagccaccctcggtgtcagtcgtcccaggacagacggccaggatcacctgctcgtggagatgcagttcgaccaaaccgnttatgtcttagttcggtaccagcagaacggccgggaccacggcccctggtgttggtgatgtaataaagacactgagacggccctagagggactcccgtagacgtacgtattcccgtcgtcggcctaccgtacgggtcgacgggaccgaaccgggtcaacgtagttcggacctagtcgagtcggacgtccgagggacaaggacggacggaaggcctaggacttaagttattacggtaactaaaattccaaaagtacgaacctaaccttagttacggttacttagtcgttaccgtagaactcgacgaacacggtccacgtccgtcggacaccgaacccgacgacccaacccctgtacgaccacttcccg

SEQ ID NO: 390466 - DNA, 547 bp, Homo sapiens
  misc_feature: GZ8MTXP02HM56F.52.86.H09.1.454.CMB.2.raw
  modified_base (284)..(284): a, c, t, g, unknown or other
  modified_base (536)..(536): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcaggcccctgtgttggngatgtataaagacactgagacggccctgagggactcccgtgacgcgtattcccgtctggctcccgaggtccgaaggggaccaacgggtcaactagtttcggccctatcgagtggaacgtccgaaggcaaggaggacgaggctgactattattgtacaatacaaacagaacacctattaggtacttatcgtacttacggaactgaccgtacaacggtccacgtccgtggtcacgcccgaaggacccaacccgntcgcctactcc

SEQ ID NO: 390467 - DNA, 563 bp, Homo sapiens
  misc_feature: GZ8MTXP02JWABQ.52.86.H09.1.454.CMB.2.raw
  modified_base (239)..(239): a, c, t, g, unknown or other
  modified_base (482)..(482): a, c, t, g, unknown or other
  modified_base (548)..(548): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaacgccgggccaggcccctgtgttggtgatgtataaagacacgtgagacggcccctgacgggtactcccgtgacgcgtattccctcgtcggctccgaggtcgaacggggaccgtaacgggtcacgtagttcgggacctatccgaggtcggacgtccgaggcgaggaggacgagggctgacttatttattgtacaatacaacagaccactagttaggtacttntcgtcttacggaacttcgacgaccgtacgtccgaccgtcgcggtacacgccgaacggcccaacccnctcgtccacttcccg

SEQ ID NO: 390468 - DNA, 644 bp, Homo sapiens
  misc_feature: GZ8MTXP02H0DAU.52.86.H09.1.454.CMB.2.raw
  modified_base (182)..(182): a, c, t, g, unknown or other
  modified_base (224)..(224): a, c, t, g, unknown or other
  modified_base (242)..(242): a, c, t, g, unknown or other
  modified_base (285)..(285): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagccaccctggtntcagtcgtcccaggacagacgccaggatcacctgctccgganatgctatcgaccaaacgntatgtacttatggtacagcgagacgccggcacgccctgtgtgngatagtaataaagacactaggaggacggccctagacgggtactcccgtagacgtctacttcgtcgtcggccttaccgagggttaccgacgggggtaactaacggtcacgtagttcggacctagtcgaaggtggacgtcgaaggacgaggacggacggacggtactacggtaactttaagtttagttacgtaactaaacgttaccaaaacgacgtaaactaccgttaagtttaggtaactttagtcgtacgttaccggtaaactcgggaacctaaacggtaacggttacccgtaccgttaccggtcgggtacaacccggaccgaaaaccggccccaaaaccctcgtacgttacctacccg

SEQ ID NO: 390469 - DNA, 595 bp, Homo sapiens
  misc_feature: GZ8MTXP02HCUYF.52.86.H09.1.454.CMB.2.raw
  modified_base (245)..(245): a, c, t, g, unknown or other
  modified_base (437)..(437): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctcccctcctcactctctgcacaggctctgaggcctcctatgagctgacacagccaccctcggtgtcagtctccccaggacagacggccaggatcacctgctctggagatgcattcgaccaaaaccgtntatgcttattggtaccagcagaagccggcacggcccctgtgttggtgatgtaataaagcacgtgagacgccctgagggacccctcgtgacgcgtattctacgtggctccgaggtcgaagggacaacggtcactagtcggccatcaggtggacgtccgaaggcgaggaggacgaggtactgtactatttagtntacaataccaaacagaactaccgtaatttcgggtaaactttcgtagttaccgtttacggaaaacgttggaacccggtaaccgaaaacggttccgaaccgttccgtaggggttccaacgaccccgaaacggacccccaaaccccgattacccggtaacc

SEQ ID NO: 390470 - DNA, 572 bp, Homo sapiens
  misc_feature: GZ8MTXP02JW63C.52.86.H09.1.454.CMB.2.raw
  modified_base (453)..(453): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtaccagcagaagccggcacggccctgtgtggtgatgtaataaacgacactagacggacggccctcgaggggactcccgtagacgcgtattccctcgtggctccgaggtccaggggacctaaccgggtcacgtagttcggacctatcgagtggacgtccgaggcgaggaggacgaggctagacttattattgactagtacaanagacacgtattacggtacttagtgtacgttacgaactcggaccgtaaccgaacggtccaaccgtccgtcggtaccacggaacccgaacggacccaacccacgtcgtaccacctttcccg

SEQ ID NO: 390471 - DNA, 701 bp, Homo sapiens
  misc_feature: GZ8MTXP02H1A88.52.86.H09.1.454.CMB.2.raw
  modified_base (225)..(225): a, c, t, g, unknown or other
  modified_base (247)..(247): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgagcctcctatgagctgacacagcccaccctcggtgtcagtcgtccccaggacaggacgccaggatcacctgctcgtgganatgactattcgaaccaaacgtnttagtgtactttagttggtaccagcaaggaacgcccgggaccacggcccctggttcggttggtagtagtagtaaataaacgacacgtaggacggacggccccgtacggagggtactcccgtaggagtcgtacttccctacgtcggtcctaccggaggtccggaacgggaccgtaaccgggtactaaccgtagttccggacccaagttccgaggtacggacgtacccggagggacgaaggacgggacggtggaccgttagacgtttaattacgttacgtacaaacttacaaacgaacgacctaacgttagttacggtttaaccttagttccgttacgtacggaaacttcggaaccgtaaccgtacggtaccgtacccggttaccgtcgggtaacccacggaaccccgaaccggtacccctaaccccgtacgttcccgtaccttaccgtttccccg

SEQ ID NO: 390472 - DNA, 536 bp, Homo sapiens
  misc_feature: GZ8MTXP02GDVXM.52.86.H09.1.454.CMB.2.raw
  modified_base (302)..(302): a, c, t, g, unknown or other
  modified_base (357)..(357): a, c, t, g, unknown or other
  modified_base (488)..(488): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtccnccaggctccgaggcaaggggctgggagtgggtgcagtatatccctatgatggaancaatagcaactacgacagacgtccgtagaagggccattcgaccatctacagagacaactacgaagaatacgtacttactaacaatagaacagccgtagagacgctagagacacggtctagttcgtttaacngtacgacgaggtacgggaactcgattacacgacgacgtccctaaacgg

SEQ ID NO: 390473 - DNA, 641 bp, Homo sapiens
  misc_feature: GZ8MTXP02IHXIB.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgtgtgatgataaagcactgagacggccctgagggatccctgacgcgtattcctctggctccgaggtcagggacaacggtcactagttcggaccagtcagtggagtccgaggcagaggacgtaggctagactattagttagtacaaatacaaacagaacctaccgatttagggttaactttaagtgtttaccgtttacggggaaacctttacggaccgtaacccgtaaacggtttacccgaaacccgggttcccgttaacgggggttacccaaaccgggtaacccccgtaaaaacccgggggtaccccccgtaaaaaccccccgaaacctttcccggtacccgtaaaaccccgtttttcccccg

SEQ ID NO: 390474 - DNA, 546 bp, Homo sapiens
  misc_feature: GZ8MTXP02IEUC2.52.86.H09.1.454.CMB.2.raw
  modified_base (426)..(426): a, c, t, g, unknown or other
  modified_base (437)..(437): a, c, t, g, unknown or other
  modified_base (461)..(461): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgacccaaacgatatgcttattggtaccagcagaagccgggccaggcccctggtgttgtgatgtaataaagacactgagaggccctgagggactcccgtgagcgtacttcctcgtggcctccgaggtcgacgggacaacggtcacgagttcggccatcgagtggagtccgaggcagagacgagctagactattagtntacaatacaanagacacctaagttcgtaattagtntacgttacggaaactcggactaccgaacgtacgaccgtcgtcgggtcacggaacccgaacggacccaacccacgtacgcactccg

SEQ ID NO: 390475 - DNA, 678 bp, Homo sapiens
  misc_feature: GZ8MTXP02GFQZZ.52.86.H09.1.454.CMB.2.raw
  modified_base (384)..(384): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccagggctgggaggtccctgagactctcctgtgcagccctctggattcaccttcagtacccatgaaatgcacgtgggtccgccaggcctccgaggcaaggggcctgggaggtggggtggcgagttatatcccctatgatggaagcaagtagcaactacgnagagtccgtggaaacgggccgagttcgaccagtcctaccaggacgaacctaaacgtacgaaacgaaacgttacggtttaccttaacgtaaacaaaattacggaaaaccgacgtacccgttaggaacggaagccgttaggaaacggaaccgtaccggggtactttaaacggtttcggtttttaaactcggggtttagtaaccggggtaaggggaaaccgggggtaaaccttaacccggggttaatttaaaccccggaaagggttcccaaaccgggtttaccccgtaaaaaccggg

SEQ ID NO: 390476 - DNA, 736 bp, Homo sapiens
  misc_feature: GZ8MTXP02FYH9Z.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttattggtaccagcagaagccgggccacggccctgtgttggtgatagtataaagacacgtggagacggcccctagaggggacttccccgtggacgcgtacttcccttcgtcggctcccgagggtccgaaacggggtacgaaaccgggtcaactacgtttcggggaccctaattccgaaagggttgggtaacgtcccggaaagggcgaaagggaacgggaccggaagggtcctagggtaaacctttagtttaaacgttcggtaacctaaaattacccaaaacgaacggtaaccctaaaccttagtttacggttaacctttaatgggttacccgtttcgggaaaaccgtttcggacccggaaaacccggtaaacggggttaccctaacccgggtttcccggtaacgggggttcccaaaccggaacccccgtaaaaccggggtacccccaaaaacccccgtcgttaacggtttccccaaccttttcccccgg

SEQ ID NO: 390477 - DNA, 655 bp, Homo sapiens
  misc_feature: GZ8MTXP02F4NOT.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgtcttattggtaccagcagaacgccgggccacggcccctgtggttggtgattgaataaaagacacgtgagaggccctgagggactccctgagcgattccctctcggctaccgaggtacgagggacgtaaacgggtcaacgtacgttcgggacctattaccgaaggtcggacgtccgaggacgaaggaacggggacgtagggacctggaaacttagtttattaggtactaaacgtacaaactaacggaaacctacctaaagtttgggttaaacctttaagttcgttaccggtttacgggaaaacttcgggtaaccgaaaccggtaaacggtacccgtaacccgtccggttacggggaccaccgggaacccaacgggacccaaaccccgtacggtctacctaaccgtttcccg

SEQ ID NO: 390478 - DNA, 580 bp, Homo sapiens
  misc_feature: GZ8MTXP02HBFA1.52.86.H09.1.454.CMB.2.raw
  modified_base (288)..(288): a, c, t, g, unknown or other
  modified_base (332)..(332): a, c, t, g, unknown or other
  modified_base (459)..(459): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatccactgctcgtggagatgctattcgacccaaacgatatgtcttagttgtaccagcagaagccggcacggccctgtgtgngatgtaataaagacactagagacggcctacgagggtactcccgngacgcgtatccctgtcggctcgaggtcgaagggacgaacggtacactagttcggacctatacgagtcggacgtccgaggacaggaggaccggaggacgttagacttattacttagactaatacaaanacgaacactagttacgttaactagttcgtacgttacgacttcgaaccgacgtacggtaccaccggtcgtacgacgacgaaccccgaaggtcccccaacctacgtacgtaccacgtttcccg

SEQ ID NO: 390479 - DNA, 551 bp, Homo sapiens
  misc_feature: GZ8MTXP02IIPDZ.52.86.H09.1.454.CMB.2.raw
  modified_base (223)..(223): a, c, t, g, unknown or other
  modified_base (240)..(240): a, c, t, g, unknown or other
  modified_base (282)..(282): a, c, t, g, unknown or other
  modified_base (336)..(336): a, c, t, g, unknown or other
  modified_base (399)..(399): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctgganatgcattgaccaaacgntatgtcttatgaccagcagaagccggcacggccctgtgtggngatgtataaagcacgtgagacggccctagaggactcccgtagacgcgtattccncgtcgctccgaggtcagggacacggtcacgagttcgcatcgagtgacgtcgagcagaggacgnggctagaactattattgtacaatacaacagaaccacgtagttacgtacttagtcgttacgttacgaacttcggacgtaaaccgacggtaccaccgttccgtacggtaccacgtaacccgacggaaccccaaccgtactcgtaccacttcccg

SEQ ID NO: 390480 - DNA, 563 bp, Homo sapiens
  misc_feature: GZ8MTXP02FSH0R.52.86.H09.1.454.CMB.2.raw
  modified_base (484)..(484): a, c, t, g, unknown or other
  modified_base (551)..(551): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaacgatatgcttattggtaccagcagaagccgggccacggcccctggtgtggtgatgtataaagacactgagacggccctcgagggactcccgtgagcgtattcctctcggctccgaggtcgaagggtaccgaacgggtacaactagtttcggacctatacgaagtggacggtacccgaggacgaaggacgggaccgaaggcgtagaacttatttatgtacaatccaaacagacacctattgtacttancgttatacggactcgaccgacgaacgtccaccgtcgtcgggtacacgccgaacggacccaaaccccnctctactactcg

SEQ ID NO: 390481 - DNA, 698 bp, Homo sapiens
  misc_feature: GZ8MTXP02HPPR0.52.86.H09.1.454.CMB.2.raw
  modified_base (244)..(244): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcaggtcgtccccaggacagacggccaggatcacctgctctggagatgcattcgaccaaacgatntgtacttatcggtaccagcagaacgccgggccacggcccctggtgttggtagtatagtaagtaaacgacacgtggagcggcctagacgggtactcccgtagagtcgtattccctcgtcgctccgaggtacgaaggaccgaaacggtcaactagttccggacacttacgagggttacgacggtacccgagggaccgaagggtaacgggacggaacggggtacctagggttaacctttaagtttagtttacggtaacctaaacgtacgtaaaacgacgtaaacccgtaaccttaaggtttacggttaaactttggtacgtttaccggtaacgttaacgccgtaaacggtaccgtaaaccggtccgttaaaccccggttccgttacgggtaccgaacccgaacccgtaaaccggaaccccctaccctaaacgtttcccggaccttaactttcccccg

SEQ ID NO: 390482 - DNA, 635 bp, Homo sapiens
  misc_feature: GZ8MTXP02IXIZV.52.86.H09.1.454.CMB.2.raw
  modified_base (303)..(303): a, c, t, g, unknown or other
  modified_base (337)..(337): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggagtcgtgggggggctggtccgaggctgggaggtccctgagactctcctgtgcagcctctgattcacttcacgtaccatagaatgacacgtgggtccnccgaggcctccgaacggcgaaggggcctaggggnggtgggtcgacgtagtatactaccgtagtagtagtaagaacgaactaaagacgacgactacgacgacgtacgtacgtacggacggacgtacgtacgacgactaccgtacgacgaacgaacgaacgtaacgaaacgtaaacgtaacgttacttaactaactaaacgtaacgaacgacgtacgtacgacgacgtacgtacgaacgaacgtaacgtacgttacgttacgtttacgttacgtacgtacggtaacggaacggtaacgtacgtaacgtacgtacgaccgtaccgtaccgtaacg

SEQ ID NO: 390483 - DNA, 693 bp, Homo sapiens
  misc_feature: GZ8MTXP02IHJC8.52.86.H09.1.454.CMB.2.raw
  modified_base (222)..(222): a, c, t, g, unknown or other
  modified_base (239)..(239): a, c, t, g, unknown or other
  modified_base (283)..(283): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatgtaccagcagaagccgggcaggcccctgtgttggngatgtataaagacactgagacggccctagagggatcccgtgacgccggtattcccgtcgtggctacgaaaggtccgaaggggaccaaacgggttcaaaccgtagtttacggacctaaagttcgaaagttgggaaacgttcccgaaggggtacccaagggtaacgggaacggacggtccgttaaggtaaccttaagtttaaagtttcggttacaaaacgtttacaaaacgtacggaaacctaacccgtaagtttaacgggttaacctttaagttacgttaccgtttaacggaaacgttacggacccggtaccgaaaacggtttccgaaacccggtttccgtacggggttaccaacggtaaccccgaaaacggaccccaaacccccgacttacggtaaccctacgttccccg

SEQ ID NO: 390484 - DNA, 661 bp, Homo sapiens
  misc_feature: GZ8MTXP02ILFFL.52.86.H09.1.454.CMB.2.raw
  modified_base (287)..(287): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgctattcgaccaaacgtatatgtacttagtcgtaccagcagacgccggcacggccctgtgtggngtatgtaataaagacagtagagacggccctagaggtctccgtagagacgtacttccctcgtcgctaccgaggtaccgaacgggaccgtaaacggtcacgtacgttcgggacctaagtcgaggttacggaccgttaccggaaggacggaagggaacggggaccggtaggtccgtaacggttaacttagtttaaacgtttacgaaacgttaaacgtacgaaacgtaaacgaaccctaacgtaagtttacggttaactttagtacgtttaccgtacggtaactcggaacgtaaccgtaacgtccgaaccgttcgtacggtaccgacgaacccgtaaccggaccctaaaccccgtagttccgtaaccgtacttccccg

SEQ ID NO: 390485 - DNA, 535 bp, Homo sapiens
  misc_feature: GZ8MTXP02GQQBN.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtacagcagaagccgggcaggcccctgtgttggtgatgtaataaagacacgtgagacggccctacgagggactcccgtgacgcgtattcctcgtggctccgaggtcgagggaccaacgggtcacgagttcggcagtcagtggaagtccgagggcagaggacgaggctagactattgttgtacaatcaacagacactattaggtacttagtgtcttacggaactcgacgaccaaaggtcaccggtctcgggtcacgcccgaacggacccacccgactcgcacttccg

SEQ ID NO: 390486 - DNA, 542 bp, Homo sapiens
  misc_feature: GZ8MTXP02GHT7M.52.86.H09.1.454.CMB.2.raw
  modified_base (414)..(414): a, c, t, g, unknown or other
  modified_base (443)..(443): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcacggcccctgtgttggtgatgtataaagacatgagacggccctgagggactcccgtgagcccgattctcgtggcctccgaggtcgacgggacaacggtcactagttcggcctaatcgaggtggacgtcgaggcaggaggacgngcgtagacttattattgtacaatacaaanacgacactagttacgtacttagtcgtcgttacggaacttgacgaccgaaacgtcgaccgtcgtgggtaacacgcccaacggcccaaaccgctacgtacc

SEQ ID NO: 390487 - DNA, 471 bp, Homo sapiens
  misc_feature: GZ8MTXP02JBC9N.52.86.H09.1.454.CMB.2.raw
  modified_base (324)..(324): a, c, t, g, unknown or other
  modified_base (355)..(355): a, c, t, g, unknown or other
  modified_base (357)..(357): a, c, t, g, unknown or other
  modified_base (362)..(362): a, c, t, g, unknown or other
  modified_base (372)..(372): a, c, t, g, unknown or other
  modified_base (374)..(374): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (389)..(389): a, c, t, g, unknown or other
  modified_base (392)..(392): a, c, t, g, unknown or other
  modified_base (394)..(394): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (461)..(461): a, c, t, g, unknown or other
  modified_base (463)..(463): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtacagcagaagccggccaggcccctgtgttggtgatgtataaagacactgagaggccctcagggatccctgagcgattcnctgctcagtcaggacacgcacatgcatcagngngcagngagagagagntnatatatntanaananaananacactatagtatatntntacgtacngacgacagacacgtcgtcgtcgacgaccaacgaccaaccacncncactctcg

SEQ ID NO: 390488 - DNA, 557 bp, Homo sapiens
  misc_feature: GZ8MTXP02H2ZS5.52.86.H09.1.454.CMB.2.raw
  modified_base (224)..(224): a, c, t, g, unknown or other
  modified_base (284)..(284): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacaggacggccaggatcacctgctctgganatgcattgaccaaacgatatgcttatggaccagcagaagccgggcacggccctgtgtggngatgtaataaagacacgtggagacggcccctagacgggtactcccgtagagcgtattcctcgtgctcgaggtcgagggcaacgtcacgtattcggacatcgagtgacgtccgaggacgagaggacgaggctagactattagtcgacaagtcaaacagacactagttacggttactgtcgtacgtacgtaactcgaccgaacgtaacggtccgacccgttcgcggtaccacgaacccgaacggaccccacccgtacgtccgtactaaccttccg

SEQ ID NO: 390489 - DNA, 666 bp, Homo sapiens
  misc_feature: GZ8MTXP02IKFOV.52.86.H09.1.454.CMB.2.raw
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggggctggtccagggctgggaggtccctgagactctcctgtgcagccctctggtattcaccttcacgtacccatgaaatgcacgtgggtcccgccaggcctccgaggcgaaggggcctgggagtggggtggctagttatatccctagtgagtggaagtcaaatagcaactacgcaagacgtaccgtaggaaacggggtccgaagttacgacctatccctacgaaggaacgaacaaaccgtacgaaaacgtaaacgttaaccggtttctttaactaacaaaagttacggaaacctaacgacccgtaggaacgacggtaacctagggaacggaaacccgtacgggtacctttaaggtttcgtttttaaaccggtggttacggaccggtaagggaacggggtaaacccgttagggtaacttacgaacggtaccgaaccgtacccgtaaaacgg

SEQ ID NO: 390490 - DNA, 526 bp, Homo sapiens
  misc_feature: GZ8MTXP02FPQC6.52.86.H09.1.454.CMB.2.raw
  modified_base (301)..(301): a, c, t, g, unknown or other
  modified_base (399)..(399): a, c, t, g, unknown or other
  modified_base (416)..(416): a, c, t, g, unknown or other
  modified_base (457)..(457): a, c, t, g, unknown or other
  modified_base (484)..(484): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggctggtccaggctgggaggtccctgagactctcctgtgcagcctctggattcaccttcagtacccatgaaatgcactgggtccnccaggctcaggcaaggggctgggagtggggtgcagttatatccctatgatggaagcaatagcaactacgcagagtccgtagaagggccgaattgaccntctcagagacatacganaaatacggttacttactaacaaatgaaacacgcctagagancgagaggacacggctagtgttttacgngtcgacgaggacgaacgtacgactacgagacacgtaccgacg

SEQ ID NO: 390491 - DNA, 612 bp, Homo sapiens
  misc_feature: GZ8MTXP02JM1MI.52.86.H09.1.454.CMB.2.raw
  modified_base (304)..(304): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagccctctggattcaccttcagtacccatgaaatgcacgtgggtccncaggctcgaggcaaggggctgggagtgggtgcaggttatatcccctatgatggaagcaatagcaactacgcagagtccgtagaacgggccgattcgaccatctcagagacaacgtacgaaagaacttacggtacttacgaactaaacttggaaacctagacccttaaggaagtacgtacgtacggaacggacctaacgggtaccgttaaatttcggtttaaaccgtggttacgaccggtaaaggtaacgggggtaaacctaccgggtaaatttaccgaacggaccgttaacggacccccgtaaaacgg

SEQ ID NO: 390492 - DNA, 602 bp, Homo sapiens
  misc_feature: GZ8MTXP02FO7WV.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggccaggcccctgtgttggtgatgtataaagacactagagacggccctacgagggctcccgtgagcgtattccgtcgtggctccgaggtaccgagggaccgaacgggtcaactagttcggacctaagtcgaagttcggacgtcccgaggcaaggaggacgaggctgacttattattgactaatacaacgagacacctattacggtactttagtgttacgtacgaaacttcgaccgaaaccgtaacggtacccgtaccggtaccgttacggggtaccaaccggaacccaaaacggggtacccccaaaacccctacttccggtacctaccggtttccccg

SEQ ID NO: 390493 - DNA, 535 bp, Homo sapiens
  misc_feature: GZ8MTXP02F58CV.52.86.H09.1.454.CMB.2.raw
  modified_base (239)..(239): a, c, t, g, unknown or other
  modified_base (305)..(305): a, c, t, g, unknown or other
  modified_base (448)..(448): a, c, t, g, unknown or other
  modified_base (518)..(518): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtacagcagaagccggcagccctgtgtgtgatgtataaagcactgagaggccctnagggactcccgtgagcgattcctcgtcggctcgaggtcaagggcaacgggtcacgagttggcatcagtgacgtccgaggcagaaggcgaggctgactattaatgtacaatcaaacacgaacaacctagttacggtactttagngtacttacggattacggcaaccgacggtctaaccggtctcgggtacacggcccaacggcccaaaccccgnttacgactactttcccg

SEQ ID NO: 390494 - DNA, 647 bp, Homo sapiens
  misc_feature: GZ8MTXP02I0FZK.52.86.H09.1.454.CMB.2.raw
  modified_base (241)..(241): a, c, t, g, unknown or other
  modified_base (288)..(288): a, c, t, g, unknown or other
  modified_base (296)..(296): a, c, t, g, unknown or other
tcagcgcagtacgacacgaccggtgctcgatttagtgctatagacttgggtttgggggtgggtccaggaggcagaactctggatgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttattggtaccagcagaagccgggccaggcccctgtgttggngatgtaanaaagacactgagaggccctgagggactccctagacgcgattctcgtggctccgaggttcaggggacaacgggtcactagttcgggccaatcgaaggttggacgtccgaggcaggacggacgaggctgaacttagttattgtactaatacaaacgtacgaacctacctagtttacggtaacctttagtacggttactttacgggtaaaaccttcggtaaccggtaaacccgtaaaacgggttcccgttaaaccccggttcccggttacgggggttacccaacccgggtacccccgaaaacggggtaccccccaaaaacccccttccgttaccgggtaccctttaaacccccg

SEQ ID NO: 390495 - DNA, 539 bp, Homo sapiens
  misc_feature: GZ8MTXP02IUY7L.52.86.H09.1.454.CMB.2.raw
  modified_base (245)..(245): a, c, t, g, unknown or other
  modified_base (501)..(501): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagccaccctggtgtcagtcgtccccaggacagacggccaggatcgcctgctctggagatgcattcgaccaaaccgntatgtcttattggtaccagcagaagccggccacggcccctgtgttggtgatgtaataaagacactgagacgccctcgagggactcccgtgacgccgtattcctcgtcggctccgaggtcgagggacaacggtcacagttcggaccatcaaggtggaacgtccaggcaggacggacgagctagactattatgtacaatcaacagacactagttgtacttagtgtcttacgactgacgtacgaacgtccgaccgtcgnggtaaccacgacccgaacggacccacccacgtcgtacc

SEQ ID NO: 390496 - DNA, 524 bp, Homo sapiens
  misc_feature: GZ8MTXP02IJ5PT.52.86.H09.1.454.CMB.2.raw
  modified_base (232)..(232): a, c, t, g, unknown or other
  modified_base (301)..(301): a, c, t, g, unknown or other
  modified_base (323)..(323): a, c, t, g, unknown or other
  modified_base (385)..(385): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagagccggcaggcccctgtgtggtgatgtataaagacactgagaggccctnaggggactccctgagcgattcnctggctccaggtcgagggacacgggtcacattggccagtcagtgagtccaggcaggagacgnggctgactattatgtcaaatcaacagacaacctagttgtactttagtgttcttacggtaactgaccgacgaaggtccaaccgtcgtcgggtaccacgacccgaaggaccccaaacccgacgtcgtaccactcgttcccg

SEQ ID NO: 390497 - DNA, 558 bp, Homo sapiens
  misc_feature: GZ8MTXP02HA0YV.52.86.H09.1.454.CMB.2.raw
  modified_base (223)..(223): a, c, t, g, unknown or other
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgntatgcttatgtacagcagaacgccggcacggcccctggtgttggtgtatgtaataaagactacgtggagacggccctacgacgggtactcccgtgacgacgtattccctcgtcgctccgaggtcgagggacgacggtcacgtacgttcggaccagtcgaaggtggacgtccgaggcaacggaggaccgaggctagacttattatgtacactacaacagaacactagttacggttacttagtcgttacgtacggaactcggacgacgacggtcacccgtcgtacggtcacgccgacgcccaaccgctacgctactccg

SEQ ID NO: 390498 - DNA, 588 bp, Homo sapiens
  misc_feature: GZ8MTXP02HJIF1.52.86.H09.1.454.CMB.2.raw
  modified_base (304)..(304): a, c, t, g, unknown or other
  modified_base (357)..(357): a, c, t, g, unknown or other
  modified_base (472)..(472): a, c, t, g, unknown or other
  modified_base (496)..(496): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctgggtggagtcgtggggggggctggtccagggctgggagtccctgagactctcctgtgcagcctctggatcaccttcagtacccatgaaatgcacgtgggtcccncaggctccgaggccgaaggggctagggacgtgggtgctagtatatcccctagngagtggaagacaatacgctaactacgcgagtacggtcccgtaggaacggggtccaagttcgaaccagtcctacgagacgaacaacgtacgaagtaacgtacgtttctacgtaaanaaatcggaaacagacctagaaganacgagacggaccaaggtctagtttagtttacgcggtgaccggaaggtacggtaaccgtaggtaacttaccgagtacgacgtaccccgaaagg

SEQ ID NO: 390499 - DNA, 567 bp, Homo sapiens
  misc_feature: GZ8MTXP02JLRIT.52.86.H09.1.454.CMB.2.raw
  modified_base (243)..(243): a, c, t, g, unknown or other
  modified_base (438)..(438): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttattggtaccagcagaagccgggccaggcccctgtgttggtgatgtataaagacactgagacggccctcgagggactccctggacgccgtattctctcggctccgagtcgagggacaacggtcaatgttggcccaatcaggtggagtccaggcaggaggacgagctagactattatgtacaatacaaanacgaacacctaagttcggttaacttagtcgtacgttacggaaacttcgaccgaaccgtacggtaccacccggttccgtacggggtaacacggacccgaaacggccctaaaacccctcgtccgtaacccg

SEQ ID NO: 390500 - DNA, 599 bp, Homo sapiens
  misc_feature: GZ8MTXP02IDOZZ.52.86.H09.1.454.CMB.2.raw
  modified_base (245)..(245): a, c, t, g, unknown or other
  modified_base (289)..(289): a, c, t, g, unknown or other
  modified_base (334)..(334): a, c, t, g, unknown or other
  modified_base (350)..(350): a, c, t, g, unknown or other
  modified_base (436)..(436): a, c, t, g, unknown or other
  modified_base (444)..(444): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggccaggatcacctgctctggagatgctattgaccaaacgntatgcttatggaccagcagaacgccggcacggccctgtgttggnatgtaataaagacactggaagacggccctagagggaccttcccgngacgccgtattctcgngctccgaggtcgagggacaacggtcactgtcgccatcgaggtggacgtccgaggacaggaggacgaggctagacttagttatgtanaatacaanagactaactagtttcggtaacttagtcgttacgttacggaaacttcggaccgttaaaaccgaaacggttcccgtaacccggttccttacgggggtaacccaaaccggtaccccgaaaccgggaccccctaaacccccggagttaccgtaaccccg

SEQ ID NO: 390501 - DNA, 596 bp, Homo sapiens
  misc_feature: GZ8MTXP02I2B90.52.86.H09.1.454.CMB.2.raw
  modified_base (238)..(238): a, c, t, g, unknown or other
  modified_base (287)..(287): a, c, t, g, unknown or other
  modified_base (390)..(390): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctggagatgcattgaccaaacgntatgcttattggtaccagcagaagccgggccacggcccctgtgttggtnatgtaataaagacactgagacggccctgagggctcccgtgacgcgtacttcctcgtgcttcgaggtcagggtacacggtcactatggaccatcgagtggtacnccgaggcgaggaggacgtaaggctagacttattatgtacaattcaaacgagaccaactagtttacggtactttaagtcgtttaccgttacggaaacttcgtaccggacctaaagggtccctaaaccggtcccgtttaggggtaccaacggaacccccggaaacggaccccaaaacccccgtacgttaccgtaccgtaccgttaccg

SEQ ID NO: 390502 - DNA, 647 bp, Homo sapiens
  misc_feature: GZ8MTXP02GZHFX.52.86.H09.1.454.CMB.2.raw
  modified_base (316)..(316): a, c, t, g, unknown or other
  modified_base (349)..(349): a, c, t, g, unknown or other
  modified_base (370)..(370): a, c, t, g, unknown or other
  modified_base (380)..(380): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggaggtcggtggggggggcgtggtccgagggcgtggggacggtccctgacgactctcctgtgcagcctgtggattcaccttcagtacccatagaaatgccacgtcgggtccncgagcctcgaggcgaaggggctgggaggtgggnggactagtagtatcccgtagngagtaggaanacgaaataggccaacgtacgactaggacgtccgtaagggaaacgggtccgtagttacgacctagtacccgtacgaagaacgaaacgaacgtacgaaaacgtaaacgttaccggttaccttaaccgtaaaacaaacgtacgaaacgacgacgtaggaacgacgtacgtaggaacggacgtacggttagttagtttacgttagacggtacgaacggtaacggaacggtaacgtacgtaacgtacgacgaccgtaccggtaaccgtaaag

SEQ ID NO: 390503 - DNA, 624 bp, Homo sapiens
  misc_feature: GZ8MTXP02JMHAJ.52.86.H09.1.454.CMB.2.raw
  modified_base (246)..(246): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgacccaaaccgtntatgcttatgtaccagcagaggccggccaggcccctgtgttggtgatgtaataaagacacgtgaggacggccctgagggtactcccgtggacgccgtattctctggtcctcgagtcgacgggactacggtcacgatcgccatcgagtggacgtccgagggacaggacggacgtaggacgtagaacgttatttaagttcgtactaatacaaacgaacgtacctaaccgtaagtttcggtaaacctttgttacgttaccgtttaacggaacgttacggtacccgaaaccgtaaacggttcccgacccggttccggtacggggtaaccacccgggtaaacccgaccggacccctaaaacccccgtcgttccggttaccccg

SEQ ID NO: 390504 - DNA, 634 bp, Homo sapiens
  misc_feature: GZ8MTXP02HKH1Y.52.86.H09.1.454.CMB.2.raw
  modified_base (248)..(248): a, c, t, g, unknown or other
  modified_base (372)..(372): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccatcctcactctctgcacaggctctgaggcctcctatgagctgacacagcccaccctggtgtcagtcgcccaggacaggacggccaggactccacctgctcgtaggagatgctattcgaccaaacgntatgtcttagtcgtacagcagacggccggaccacggtccctggttggttggtagtagtagtaataaacgacagtaggacgacggccagacgggtactccgtagacgctattctcgtcgcctcgnggtacgaacggactaacgtcacgtacgttcgactagtacgtagtggacgtaccgaggacgaagggacgggtacggtacggcgttaacggtattaacgtttagtttacgtaacgtaactaaccaaacgtagaacctaaccgttagtttaacggttactttacgtcgttaccgtttacggaacttcgaaccgtaccgtaacggtccgtaaccggttccgtcggggaccaccggacccgaaccggacccctaaccgtacgtcccg

SEQ ID NO: 390505 - DNA, 627 bp, Homo sapiens
  misc_feature: GZ8MTXP02I0JOB.52.86.H09.1.454.CMB.2.raw
  modified_base (245)..(245): a, c, t, g, unknown or other
  modified_base (294)..(294): a, c, t, g, unknown or other
  modified_base (610)..(610): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatccacctgctctggagatgcattgacccaaaccgntatgcttattggtaccagcagaacgccgggccacggcccctgtgttggnatagtataaagactactaggagacggccctcgagggacttcccgagagtcgtattcctccgtcggtcctaccggtaggtaccgaacggggtaccgtaaccgggttaccaacgtacgttccggggaccctagttcgacgggttagggaccgtccggaagggaccgaggaaacggggccggaaggtcccgtagtaagtatttagttcgtactaaacttacaacagaaccactagtttacgtacttagtcgtacgttacgaactagccgaacgtaacggtccacgtcgtcggtaccacgcccgacggtacccaaacccngtacgacctacttcccg

SEQ ID NO: 390506 - DNA, 700 bp, Homo sapiens
  misc_feature: GZ8MTXP02GRNMD.52.86.H09.1.454.CMB.2.raw
  modified_base (226)..(226): a, c, t, g, unknown or other
  modified_base (245)..(245): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagcccacccgtcggtgtcagtcgtccccaggacagacggccaggatcactgctcgtgganatgctattcgaccaaacgntatgtcttatggtaccagcaagaacggcccgggccacggtcccctggtggttggtgtatagtaaataaacgactacgtaggaaggtacggccccgtacggagggtactccccgtaggacgtaccgtacttccccgtcgtcggtaccctccggaacggtccggaagggaccggtaaacgggtacaacgttacgttcgggaccagttaccgagggttcggaaccggtccgaacgggacgtaaagggacgggaaccggagggtccgttaagtacgttaatttacgttacgtaaactaactacgaaaccacggttaaccaaccgttagtttaggttaaccttagttacgttaccgttacgactacggtaccaccgtaaacggtcctaaccgtccgtacggtaccgaaccgaaccccgaaacggcccctaaaacccgtcgtacgtacctactttccccgg

SEQ ID NO: 390507 - DNA, 542 bp, Homo sapiens
  misc_feature: GZ8MTXP02J25BP.52.86.H09.1.454.CMB.2.raw
  modified_base (221)..(221): a, c, t, g, unknown or other
  modified_base (241)..(241): a, c, t, g, unknown or other
  modified_base (287)..(287): a, c, t, g, unknown or other
  modified_base (326)..(326): a, c, t, g, unknown or other
  modified_base (351)..(351): a, c, t, g, unknown or other
  modified_base (441)..(441): a, c, t, g, unknown or other
  modified_base (446)..(446): a, c, t, g, unknown or other
  modified_base (499)..(499): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctctcactctctgcacaggctctgaggcctcctatgagctgacacagccaccctcggtgtcagtcgtcccaggacagacgccaggatcacctgctcgtgganatgctattcgaccaaacgtntatgtacttatggtaccagcaggacgccggcacggccctgtgttgnatagtaataagcactgacgacgccctagaggtactccgngacgcgtacttcctcgtcgctacgngtacgagggtacacggtcacagttcgactatcgagtcggataccgaggcgaaggcggtacgagactacgtacttaattagtacgtacaancaaanacgactactagttacgtacttagtcgttacgtacgactcgacgacgacgtacncgtcgtcggacacgaaccgacgaccaccgactcgacctctccg

SEQ ID NO: 390508 - DNA, 653 bp, Homo sapiens
  misc_feature: GZ8MTXP02GINQ3.52.86.H09.1.454.CMB.2.raw
  modified_base (153)..(153): a, c, t, g, unknown or other
  modified_base (290)..(290): a, c, t, g, unknown or other
tcagcgcagtacgacacgaccggtgctcgatttagtgctatagacttgggtttgggcacgaccggtgctcgatttagtgctatagacttgggtttgggggctgtgggtccaggaggcagaactctgggtgtctcaccatggcctggatccctntacttctccccctcctcactctctgcacaggctctgaggcctcctatgagctgacacagccaccctggtgtcagtcgtccccaggacagacggccaggactcaccctgctcgtggagatgcattcgacccaaaccgntatgtcttagttaggtaccagacgaagaacggcccggggacccacggtcccccgttaggttcggtttggggtaggtaagttaggtaaacgttaaaaacgaccgtaaccgttaggaacggaacgggtccccgttacgaacggggtaactcccgtagacgtcgtacttcgtctcggctaccgagggtaccgagggacctaacgggtctaacgacgttcgacctagtccgaaggttcggacgtaccgaggaccgaaggaacggacggaggtctagtacttaagttagtacgttacaaagtaccaaacgtacgaactaccgtaagttaacggtaacttagttcgtacgttacgtaacgttgaacccg

SEQ ID NO: 390509 - DNA, 573 bp, Homo sapiens
  misc_feature: GZ8MTXP02JRMJC.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtataaagacactgagacggccctcgagggactcccgtgagcgtattcctctggctccgaggtcgagggacacggtcactattcggccatcgagtcggagtccgaggcagaggacgaggctagactattatgtacaatcaacagacacctagttggtaacttagtgttacgttacggaacttcggaccgaaccgtaacggtccaacccggttccgtacggggtcccaaccggaaccccgaaaccggaccccctaaacccccgtactcgtaccctactttccccg

SEQ ID NO: 390510 - DNA, 650 bp, Homo sapiens
  misc_feature: GZ8MTXP02I6Z4N.52.86.H09.1.454.CMB.2.raw
  modified_base (222)..(222): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccggcaggcccctgtgtggtgatgtataaagcactgagacggccctgagggactcccgtgacgcgtacttcctcgtcggctaccgaggtaccgaaggggacctaacgggtcactagttcgggacctaatcgaagtggtacgtaccgaggcaaggaggaccgaaggtcctagaacgttatttagttggtaacaaataccaaacacggtaaccaaccgtagtttacggttaactttaagttcgttacgtttaccggaaacgttcggaccggaaaaccgtaacggtacccgtaaacccggttcccggtacggggttacccaaacggaacccccgaaaacggacccccaaaaacccccgtctttaccggttaacccaccgtttaccccgg

SEQ ID NO: 390511 - DNA, 685 bp, Homo sapiens
  misc_feature: GZ8MTXP02IV3Q1.52.86.H09.1.454.CMB.2.raw
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggaggtcggtggggggggctgggtccgagggcgtggggacggtccctgagactctctgtgcagcctctggattcaccttcacgtacccatagaaatgcacgtcgggtcccgccgtaggcctccgaggcgaaggggcgtagggaggtggggtcggcgtaggtttaatatcccctagtaggatagggaagacaaatacgactaacgtacgacgaaggtacgtacccggtaggaaacggggtcccgaagtttacggaaccctacgttacccgtacccgaaggaacgaaccaaacgtaccgaaaagtaaacgttaccggtttacttaacgtaaactaaaagttacggaaacaacgtccgtaaggaagacgtacgtaaggacgggaactacgggtacttagttacggtttaacgtggttacggaccggtaaggtaaccgggtaaagttcgaaacgttaaccgacgtaccgacgaccccgtaaaacgg

SEQ ID NO: 390512 - DNA, 595 bp, Homo sapiens
  misc_feature: GZ8MTXP02F1JD7.52.86.H09.1.454.CMB.2.raw
  modified_base (240)..(240): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgctattgaccaaacgntatgcttagttggtaccagcagaagccggcacggccctgtgttgtgatgtataaagacagtgagacggccctagagggactcccgagacgcgtattcctcgtcggctccgaggtccgaaggggtccaaacgggtcaacacgttggcccaagtcaggtggactccgaaggcgaagacgggacgaggtactagaacttatttagttacgtaacaactacaaacagaacctaccgtagttacggttaactttagtcgttacgttacggaactcggaaccgacgtaacggtccgaccgttacgtacggaccgaacgaacccgaacggaccctaaaccccgattacggtacctactcccg

SEQ ID NO: 390513 - DNA, 776 bp, Homo sapiens
  misc_feature: GZ8MTXP02F2B1C.52.86.H09.1.454.CMB.2.raw
  modified_base (224)..(224): a, c, t, g, unknown or other
  modified_base (766)..(766): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgatatgtacttagttcggtaccagcaaggaacggccgggaccacggccctgtggttgtagatagtaaataaaacggacctacgtaggaacggtaccggtaccccgtaggaacggggtaccttaccccggtagaaccgtcggttactttccccgtaccgttcggacccgtaccgtacggggtaccgaacggggtaccgtaaaccgggtaccaaacgttagttaccggacccttaagtaccgtaaggggtaggtaacccgtaccggaaggggaccgaaagggaacgggacggaacggttacgtaacgggttaaacctttaaagttttaacgttacggtaaacctaaacgttaaccaaaacggaaacgtaaaccctaaccgtttagtttaacgggttaactttaacggttcgtttacggtaaccggtaacgttacggaacccggtaaaccggtaacggtacccctacgggttcccgtacggtaccgaccgaaccccgaaccggaccccaacccctacgtccgtaaccnccgtttaccc

SEQ ID NO: 390514 - DNA, 623 bp, Homo sapiens
  misc_feature: GZ8MTXP02G9F49.52.86.H09.1.454.CMB.2.raw
  modified_base (222)..(222): a, c, t, g, unknown or other
  modified_base (239)..(239): a, c, t, g, unknown or other
  modified_base (280)..(280): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgtcttatgtacagcagaagccggccaggccctgtgtgngatgtaataaagacactgagacggccctacgagggtactcccgtagacgcgtattccctcgtcggcctcggaggtaccgaagggaccgtaacgggtacactagttcgggacctaagtcgtaaggtggacgtccgaggacaaggaggacgagtactagtaacttagtttaattcgtaacaactacaaacacgtaaccaccgtaagtttacggttaacttagttcgttacgtttacgaaacgttcgaccgtaaacgaacgggttaccctaaccggttccgtacgggtaaccaacgtaaccccgaaacggaccccaaacccctacgtaccgtaccaacctttcccg

SEQ ID NO: 390515 - DNA, 605 bp, Homo sapiens
  misc_feature: GZ8MTXP02JETVA.52.86.H09.1.454.CMB.2.raw
  modified_base (239)..(239): a, c, t, g, unknown or other
  modified_base (286)..(286): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccaggcccctgtgttggngatgtaataaagacacgtgagacggccctgagggactcccgtagacgcgtattccgtcgtggcctccgaggtcgaaggggacctaacgggtcaacgtagttcgggacctaagtccgaggtggacgtcccgagggcaagggacggacggaggcgtagacttattagttgtacaatacaaacgacgaacaccgtagttaggtaacttagtgttacgttacggaactcggaccgaccgtaaacggttccaaccggttccgtacggggtaccacggaacccgaaacggaccccaaaccccgtagtccgtacctacgtttcccg

SEQ ID NO: 390516 - DNA, 603 bp, Homo sapiens
  misc_feature: GZ8MTXP02JDR3N.52.86.H09.1.454.CMB.2.raw
  modified_base (243)..(243): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgntatgtcttatcggtacagcagaacgccggcacgccctgtgtgtgatgtataaagcatgagcggcctacgaggactcccgtgacgcgtacttccgtcgtcggcctacgaggtaccgaagggacgtaaccggtcaacgtagttcggacctatacgagtcggacgtccgaggcagggagcggagctagacttagttaatgtacaattacgaaactacggaacctaacgtagttacggttaacctttagtcgttcgtttaacgacgtacgtaccgaaaccgtacggtaccgtacccgtcgtacgggtccaaccggcccgaaaccggtaccccaaacccgtagttaccgtacctcctttaccccg

SEQ ID NO: 390517 - DNA, 641 bp, Homo sapiens
  misc_feature: GZ8MTXP02J259S.52.86.H09.1.454.CMB.2.raw
  modified_base (179)..(179): a, c, t, g, unknown or other
  modified_base (242)..(242): a, c, t, g, unknown or other
  modified_base (501)..(501): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtntcagtcgtcccaggacagacggccaggatcacctgctcgtggagatgctattcgaccaaacgnttatgtcttatcggtaccagcaagaggccggcacggccctgtgttgtgatgtaataaagacacgtggacgacggtccctagacgggtactccgtagacgcgtacttcctcgtcgcctacgaggtccgaaggggtaccaacgggttaccaacgtacgttcggaccctaaagtccaggttacgggacgtaccgaacgggacgaaggagggaaccgagggtactacggtacttaagttaacgttcgtaacaaactaccgaanaaccggtaacctaacctaagtttacgtaacttagtcgttacttacgggaacttcggaccgtacgacggtacctaccggtcgtacggaccgaccgaacccgaaccggaccccaaaccctcgtacgtacctaccgtttcccg

SEQ ID NO: 390518 - DNA, 544 bp, Homo sapiens
  misc_feature: GZ8MTXP02F17V4.52.86.H09.1.454.CMB.2.raw
  modified_base (240)..(240): a, c, t, g, unknown or other
  modified_base (311)..(311): a, c, t, g, unknown or other
  modified_base (531)..(531): a, c, t, g, unknown or other
  modified_base (539)..(539): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggacaggatcacctgctctggagatgcattgaccaaaccgntatgcttattggtaccagcagaagccgggcaggcccctgtgtggtgatgtataaagcactgagaggccctnaggtactccgtgacgcgtattcctctggctcgaggtcagggcaaacggtcacgattcggacctatcgagtggagtccgaggcagaggacgaggctgaactattagttgactaaatcaaacaggaacacctagttacgtacttagtcgttacttacggaactggccgaaccgtaaagtccaaccggtcgttaggccaagccccgaacggcctaaacccccnctcgtacnctccg

SEQ ID NO: 390519 - DNA, 535 bp, Homo sapiens
  misc_feature: GZ8MTXP02GU5ER.52.86.H09.1.454.CMB.2.raw
  modified_base (302)..(302): a, c, t, g, unknown or other
  modified_base (360)..(360): a, c, t, g, unknown or other
  modified_base (404)..(404): a, c, t, g, unknown or other
  modified_base (415)..(415): a, c, t, g, unknown or other
  modified_base (431)..(431): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggagtcgtggggggggctggtccaggcgtgggagtccctgagactctcctgtgcagcctctggatcaccttcagtacccatgaaatgcactcgggccncgaggctccgaggcgaaggggctgggagtggggtgcagtatatccctatgatggaacncaaatagcactagcagatcgagaaggccatgaccatcgacaganacaatacgaanaatcgttatactaaanaatacgaacacgacgtagagagcgagacgaacgacgtattagttacgttacgtggacgacggaagaacggaacgtacgtaacgtacacgacaacgtacccgaag

SEQ ID NO: 390520 - DNA, 585 bp, Homo sapiens
  misc_feature: GZ8MTXP02GW8PW.52.86.H09.1.454.CMB.2.raw
  modified_base (285)..(285): a, c, t, g, unknown or other
  modified_base (451)..(451): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtaccagcagaagccgggcacggccctgtgttggngatgtaataaagcactgagacggccctagagggactcccgtgacgcgtattcctcgtcggctccgaggtcgaaggggacctaacgggtcacgtagttcggaccaagtccgaagtggacgtccgaggcaaggaggacgtaggctagactattatgtacaatacaaangaaccaccgtagttcggtaactttatgttacttacgggaaacttcggaccgtaacgtaacggtccgaacccgttcgtacgggtaccacgaacccgaaacggaccccaaaacccctctaccgtccacgtttcccg

SEQ ID NO: 390521 - DNA, 524 bp, Homo sapiens
  misc_feature: GZ8MTXP02JCC1M.52.86.H09.1.454.CMB.2.raw
  modified_base (303)..(303): a, c, t, g, unknown or other
  modified_base (375)..(375): a, c, t, g, unknown or other
  modified_base (384)..(384): a, c, t, g, unknown or other
  modified_base (432)..(432): a, c, t, g, unknown or other
  modified_base (488)..(488): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgcttcttttaagaggcgtccagtgtcaggtgcagctggtggagtcgtggggggggctggtccaggctgggaggtccctgagactctcctgtgcagcctctggattcaccttcagtacccatgaaatgcactgggtccncaggctcaggcaaggggctgggagtggggtggctagttatatcccctatgatggaagcaatagcaactacgnagagtccgngaaggccattcgacatcgtccagacgacaactcgaaataagtacgttntactacgaaatgaacagcctagacgagctgagacacggtactattgtttactggtnacggagaggaactcgattacgagcaacgccctaaag

SEQ ID NO: 390522 - DNA, 596 bp, Homo sapiens
  misc_feature: GZ8MTXP02J2MM0.52.86.H09.1.454.CMB.2.raw
  modified_base (219)..(219): a, c, t, g, unknown or other
  modified_base (241)..(241): a, c, t, g, unknown or other
  modified_base (280)..(280): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctntggagatgcattgaccaaacgntatgcttatgtaccagcagagccggcaggccctgtgtgnatgtataagacatgagcggccctgaggtactcccgtgacgcgtattccctacgtgcctcgagtcgaagggaccgaacggttacacgtagttcggacctagtcgaggtcggacgtaccgagggacaagggaggacgaggtccgtagtacttaattagttagtacaaactccgaaaacacgaacctaaccgtaagtttacggtaactttaagtcgttacgttacgggaactcgaccgaaaccgaacggtccgtaaccggtcgtacgggtaccaacggaacccgaaaccggacccaaccctacgtctaccgacttcccg

SEQ ID NO: 390523 - DNA, 570 bp, Homo sapiens
  misc_feature: GZ8MTXP02HWO1X.52.86.H09.1.454.CMB.2.raw
  modified_base (222)..(222): a, c, t, g, unknown or other
  modified_base (239)..(239): a, c, t, g, unknown or other
  modified_base (286)..(286): a, c, t, g, unknown or other
  modified_base (394)..(394): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtaccagcagaagccgggccaggcccctgtgttggngatgtaataaagacactgagaggcccctgagggactcccgtgacgcgattcctctggctccgagtcgagggcaaagggtcaacattggccatcagtggagtccagganaggaggacgagcgagacttattaattgtactaatacaaacacgaactactaagttaggttaacttagttgttacgttacgtaacgtcgtaccgaaaccgaacgtacctaacccgtccgtacggtacacgaacccgaaaccggtaaccccaaccccgacgttacgtacctacctccg

SEQ ID NO: 390524 - DNA, 531 bp, Homo sapiens
  misc_feature: GZ8MTXP02I05MT.52.86.H09.1.454.CMB.2.raw
  modified_base (239)..(239): a, c, t, g, unknown or other
  modified_base (284)..(284): a, c, t, g, unknown or other
  modified_base (342)..(342): a, c, t, g, unknown or other
  modified_base (415)..(415): a, c, t, g, unknown or other
  modified_base (429)..(429): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgttggnatgtaataaagacactgagaggcccctcgagggactccctgacgcgtattcgcaggcnccaggtcgagggcaacgtcacagttggaccagtcgagtggagccgaaggcagaggacgaggctgactattatntacaattcaacganacactagttgtactatcgtacgtacgaactcgacgacgtacgtacgtaccgtccgtcggtacgaccgaaccgaccgaccgacccaccgtacgtacgtactcg

SEQ ID NO: 390525 - DNA, 614 bp, Homo sapiens
  misc_feature: GZ8MTXP02JGSU1.52.86.H09.1.454.CMB.2.raw
  modified_base (239)..(239): a, c, t, g, unknown or other
  modified_base (281)..(281): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttagtgtacagcagacgccggcacgccctgtgtggtnatgtataagacacgtgagacggccctcgagggtactcccgtgacgcgtattccctcgtaggctccgagggtccaaggggaccaacgggtcaactagtcggccatcgagtggacgtccgaaggcaagagacgaggtctagacttattagtgactatcaaacacgaaccacgtagttaggtacttaagtcgttaccgttacgggaacttcgggaccgtacccgtaaacgggtacctacccggttaccggttacggggtaccaacccgggtaacccccggaaaccggtaaccccccaaaccccggtaacgtttccgaacccgtaccctttccccgg

SEQ ID NO: 390526 - DNA, 582 bp, Homo sapiens
  misc_feature: GZ8MTXP02JEEFD.52.86.H09.1.454.CMB.2.raw
  modified_base (241)..(241): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttatgacagcagaagccggcacggccctgtgtggtgatgtaataaagacacgtagagacggccctacgagggactcccgtgacgcgtattcctcgtggcctcgaggtacgagggaccaacggtcactagttcggacctagtcgagtggacgtccgaggcaggagacggagctagacttattaactgtacaatacaacacgacacgtagttacgtacttagtgtacgttacgaaacttcggaaccgtaacgtaacggtaccacccggttcgtacgggtccaaccggaaccccgaaacggacccctaaaccccgagtttaccgacctaacgtttcccg

SEQ ID NO: 390527 - DNA, 572 bp, Homo sapiens
  misc_feature: GZ8MTXP02GP67C.52.86.H09.1.454.CMB.2.raw
  modified_base (233)..(233): a, c, t, g, unknown or other
  modified_base (274)..(274): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggacagcagagccggcacggccctgtgtggtnatgtaataaagacacgtgagacggccctagagggtactcccgtgagcgtattctccgtggctcgaggtacgaggacacggtcacgtagttcggacctagtcgaaggtcggacgtacccgagggacaaggacggacggaggctagaacttattagttgacaaatcaaacagaactacctagttaggtacttagtcgtacgttacgtacgcgtacgacgtaagtccgtaaccgtcgtacgggacaccggtacccgaacggtaccccaaaaccctctaccgtacctacgttccgttccccg

SEQ ID NO: 390528 - DNA, 706 bp, Homo sapiens
  misc_feature: GZ8MTXP02J1395.52.86.H09.1.454.CMB.2.raw
  modified_base (243)..(243): a, c, t, g, unknown or other
  modified_base (341)..(341): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggatcacctgctctggagatgcattcgaccaaacgtntatgtcttagttggtaccagcaggaacggccgggaccacggcccgtgtgttggtgatagtaataaagacagtagaggacgccctacgagggactccgngacgtcgtacttccgtcgtcggccgttaccggacggtaccgaacggggtaccgaacgggtaccgtaacgtagttcggaccctaagtcgtaggttcggaacgtcccggaaggacgtaaggacgggacggaacgtcgtaacggtacttaagtttaaagttcgtaactaaactaacgaactaacggaaacctaccgtagtttaaccggttaatttagtaccggtttacgttaaccggtaaccgttacggtaaacccgaaacggtaacccggttaccgtaaacccggttcgtacggggttacccgaacggaaccccgaaaccgggaaccccctaaaacccggtcctacgttaccctaactttcccccgg

SEQ ID NO: 390529 - DNA, 698 bp, Homo sapiens
  misc_feature: GZ8MTXP02HRIOT.52.86.H09.1.454.CMB.2.raw
  modified_base (284)..(284): a, c, t, g, unknown or other
  modified_base (670)..(670): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccagcccctgtgttggngatgtaataagacacgtgagacggccctgagggtactccctagacgcggtattccctcgtcgtccgtccgaggtcccgaaggggaccgtaaacgggtacacgtacgttggacccagttcgaaggttggaccgtacgaacgggcaaggaagggaccggaaggtccgtagggtaacctttaagtttacgtttacggtaactaaacttaacaaaacgtaacggaaaccctaaccgttaaggtttacggttaaccttttaaggttaccgttacgtttaccgggaacgttacggaacccggtaaccgtaaaccgggttacctaacccggttccggttacggggtaccctaccggaacccccgaaaaccgggtacccccaaaacccccggtntacccggttaccgtaaccctttcccccg

SEQ ID NO: 390530 - DNA, 655 bp, Homo sapiens
  misc_feature: GZ8MTXP02I44NS.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcacggccctgtgttggagatgtaataaagacacgtgagacggcccctgagggtactcccgtgacgcgtacttccgtcgtggcctaccgaggtccgaacggggaccaacgggtcaacgtacgttcgggaccctaaatccgtaagttcggacgtaccgaagggcgaagggaacgggacggaggtctaggaacttagtttacgttcggtaactaaacttacaaaaccgtacggaaacctaccgtaagtttacggttaacctttaagtcgtttacgttaccggtaaacttcggacggaaacccgtaaacgggtccctaaccggttccgtaacggggtccaaaccggcccgaaacggtaccccaaaccccgtagtcccgtacaccctttcccg

SEQ ID NO: 390531 - DNA, 630 bp, Homo sapiens
  misc_feature: GZ8MTXP02FS1B1.52.86.H09.1.454.CMB.2.raw
  modified_base (183)..(183): a, c, t, g, unknown or other
  modified_base (228)..(228): a, c, t, g, unknown or other
  modified_base (247)..(247): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggatcacctgctcgtgganatgcattcgaccaaacgtntatgcttattcggtaccagcagaacggccggccacggcccctgtgttggtgagtgtaataagacacgtgagacgccctgaggactccgtgacgcgattcgtcgtcggctaccgaggtcgacgggactacggtcactgttcggacctagtcgaaggtggacgtccgaaggcgaggaggacgagcgtagacttattattgactaatacaaacgacgacctaacctagtttacggttaacttagtacgttaccgtttacggaaaccgttcggaaccgtaaaccgtaaccgggttacctaacccggttcccggttaacggggtaaccgaacccggacccccgaaaccgggtacccccgaaaacccctaccgttccggtttaaccccg

SEQ ID NO: 390532 - DNA, 628 bp, Homo sapiens
  misc_feature: GZ8MTXP02IOGFZ.52.86.H09.1.454.CMB.2.raw
  modified_base (238)..(238): a, c, t, g, unknown or other
  modified_base (288)..(288): a, c, t, g, unknown or other
  modified_base (323)..(323): a, c, t, g, unknown or other
  modified_base (571)..(571): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctctatgagctgacacagccaccctcggtgtcagtgtccccaggacagacggccaggatcacctgctctggagatgcattgaccaaacgntatgcttattggtaccagcagaacgccgggccacggcccctgtgttggtnatgtaataaacgacactgagacggcctcgagggtntctctgagtcgacttctgtcggctcacggtcacgggggacaacgggttcaacgtagttggccatcgaggtcggtagccgagggcaaggagggacgacggctaggtaactttattattgtaactaagtaccaaacacgacctaaccgttagttaccggtttaaacttagttcgttaccgttaccggtaaaacgtcggtaaccgaaaccggtaaacggttacccgacccggttaccggtcggggtaaccncccggaacccgtaaccgggaacccccaacccccggtaagtccgtacccgttaacccc

SEQ ID NO: 390533 - DNA, 607 bp, Homo sapiens
  misc_feature: GZ8MTXP02JL7LM.52.86.H09.1.454.CMB.2.raw
  modified_base (304)..(304): a, c, t, g, unknown or other
  modified_base (360)..(360): a, c, t, g, unknown or other
  modified_base (550)..(550): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggcgtggtccagggctgggaggtccctgagactctcctgtgcagcctctggattcaccttcagtacccatgaaatgcactgggtccncaggctccgaggcaaggggctgggagtgggtgctagttatctccctatgatggaancaaatacgcaactacgacaggacgtaccggtagggaaacgggcccgtaagttcgaacctattcccgtaccaaggaacaacctaaacgtaccgaaagtaaacgttaccggtttacttaacgtaacaaagttacgaaacacggacctaggagtacgcgtagacggaacacgggtacttagttcgtttaacgngtacggacggaggtaacgggaactacgtacgttacgagaccgtacgaccgtaaacgg

SEQ ID NO: 390534 - DNA, 571 bp, Homo sapiens
  misc_feature: GZ8MTXP02JTEXB.52.86.H09.1.454.CMB.2.raw
  modified_base (222)..(222): a, c, t, g, unknown or other
  modified_base (241)..(241): a, c, t, g, unknown or other
  modified_base (283)..(283): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgganatgctattcgaccaaacgntatgtacttagtgacagcagacgccggcacgccctgtgtggngatagtataagacagtgagcgcctcgaggtctccgtgacgcgtattccgtcgtggcctacggagggtacgacgggaccgtaaacggtcaaccgtagttccggaccgtaatcggaaaggttcgggaacgtcccgaaggacgaagggacggaccggaggtctaggaacttagtttatgtaacatacaacacgacactagttcgtattgtgttcgtacgaactcggactaacgagtcctaccggcttcggaccacgcccgaacggaccctaaccgatccgtcaccgttccc

SEQ ID NO: 390535 - DNA, 696 bp, Homo sapiens
  misc_feature: GZ8MTXP02G77BK.52.86.H09.1.454.CMB.2.raw
  modified_base (242)..(242): a, c, t, g, unknown or other
  modified_base (288)..(288): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgcattgaccaaacgntatgtcttatgtaccagcagaacgccggcacggccctgtgttgganatgtaataaagacacgtagagacggccctacgagggtactcccgtaggacgtacgtacttcccgtcgtcgggtctaccgtagggttaccgaacggggtaccgaaaaccggggttcaaaccgtacgttcggggaaccctaagtaccgaaggttacgggaacgtacccgaagggaccgaagggaacggggtaacggaagggtccgttaaggaacgtttaagtttatttacggttaaacaaacgttaaccaaaaccggttaagaaaccgtaaccttaagtttacggttaaactttagttacgttacgtttacgggaaaacttcggaaccggaacctaaacggggtccctacccggttcgaacgggtcaaccgaaccgaaccggaccctaaaccgctcgtacctcgttcccg

SEQ ID NO: 390536 - DNA, 668 bp, Homo sapiens
  misc_feature: GZ8MTXP02GD64D.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccacggcccctgtgtggtgatgtaataaagacactgagaggccctgagggactccctgagcgtattcctctcggctccgtaggtcgaagggacaacgggtcactagttcggacatcagtcggacgtacgagggccaaggacgggaacggaacgggtcctagggtaaccttaatttacgtttacgtaactaaacgtacctaaaacgaacggtaaccaaccctaagttttacggttaacttttaaacgtcgtttacgtttaaccgggtaacttacggtaccgaaaccgtaaacggggttaccctaaacccggttcccggttacggggtaccgaacccggaaccccgaaaaaccgggacccccaaaacccccgtactaccggttacctaactttcccccgg

SEQ ID NO: 390537 - DNA, 669 bp, Homo sapiens
  misc_feature: GZ8MTXP02HRLQS.52.86.H09.1.454.CMB.2.raw
  modified_base (268)..(268): a, c, t, g, unknown or other
  modified_base (386)..(386): a, c, t, g, unknown or other
  modified_base (398)..(398): a, c, t, g, unknown or other
  modified_base (605)..(605): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggcgtggtccgaggcgtgggaggtccctgacgactctcctgtgcagcctntggattccaccttcacgtacccatgaaatgacacgtgggtcccgccaggcctaccgaggcgaagggggctcgggtaggtgggtaggcctaggttactagtcccctgtagatagggaanctaaatagctanacgcaagacggtaccgtaggaacggcccgtagttacgaaccacgttaccgtaacccgaagaacgaaccgtaaacgacgtaaaacggtaaacgtttaaccggtttactttaaaccgtaaacctaaaagttaacggaaacttaaccgaccgttaggaaggaccgttacgaagggtacggacgtaacgggtactttagttacgttttacncggttagacggtaaggacggtaacgtacgtacgttaacgacgtaccgaaccgtacccgtaaacg

SEQ ID NO: 390538 - DNA, 648 bp, Homo sapiens
  misc_feature: GZ8MTXP02G4HF0.52.86.H09.1.454.CMB.2.raw
  modified_base (217)..(217): a, c, t, g, unknown or other
  modified_base (235)..(235): a, c, t, g, unknown or other
  modified_base (280)..(280): a, c, t, g, unknown or other
tcagcgcagtacgacacgaccggtgctcgatttagtgctatagacttggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgganatgcattcgaccaaacgntatgcttataggtaccagcagaacgccggccaggccctgtgtggngatagtaataaagacataggagacggcccctagacgggactccctaggacgcgtacttcgtccgtacggctacgaggtacgaacggggactacgggtctaaacgtacgttacgggaccctaagttaccggagggttcgggacgtacccgaagggaccgaaaggggacgggtaaacggtacggggaccttaaggtaacctttaagtttagtttacgtactaaaacttacgaaaacgtaacgaactaaccgtagtttacggtaactttagacgttacgtacggactcggaccgtaacgacgttaccgaccgttcgtcgtaccgacgaacccgaacggacccaacccgtactctaccacttacccgtcccg

SEQ ID NO: 390539 - DNA, 666 bp, Homo sapiens
  misc_feature: GZ8MTXP02G3T26.52.86.H09.1.454.CMB.2.raw
  modified_base (225)..(225): a, c, t, g, unknown or other
  modified_base (243)..(243): a, c, t, g, unknown or other
  modified_base (285)..(285): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggatcacctgctcgtgganatgcattcgaccaaacgntatgcttagtgtacagcagacgccggcacgccctgtgtggtnatgaataacgactacgtggagacggtcccctagacgggactcccgtagacgtcgtacttcccgtcgtcggcctccgaggtacgacggggacctacgggtacaacgtagttaccggacctaagtaccgtaggttacgggaacggttacccgaaggggccgaacgggaacgggacggacggtccgtaaggtaactttaagtttacgttagtaccaaacgtacaaacgacgacctaacgtagtttaacggtaactttagttacgttaccgttacgtaacgtcggtaccgtaaccggtacgttcccgaaccggtttccggacggtaccgaccggaacccgtaacggacccctaaaccccgtgtaccggtaacctacctttcccgg

SEQ ID NO: 390540 - DNA, 529 bp, Homo sapiens
  misc_feature: GZ8MTXP02FN1IU.52.86.H09.1.454.CMB.2.raw
  modified_base (161)..(161): a, c, t, g, unknown or other
  modified_base (302)..(302): a, c, t, g, unknown or other
  modified_base (358)..(358): a, c, t, g, unknown or other
  modified_base (380)..(380): a, c, t, g, unknown or other
  modified_base (437)..(437): a, c, t, g, unknown or other
  modified_base (458)..(458): a, c, t, g, unknown or other
  modified_base (491)..(491): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagctgggttttccncgttgctcttttaagaggcgtccagtgtcaggtgcagctggtgagtcgtgggggggctggtccaggctgggaggtccctgagactctcctgtgcagcctctggattcaccttcagtaccccatgaaatggcatggggtccncaggctccaggcaggggctgggagtggggtgcagttatagtcccctatgatggaancaatagcactagcagagtccgngaagggccgattgaccatctacccagagaacactacgaagaaatacggtcttctaanaatagaactagcctagacggntccgagaggacacggactattcgtttaactggngtcgagagggaaactcggaattacagcacgccctaacg

SEQ ID NO: 390541 - DNA, 683 bp, Homo sapiens
  misc_feature: GZ8MTXP02H14X0.52.86.H09.1.454.CMB.2.raw
  modified_base (249)..(249): a, c, t, g, unknown or other
  modified_base (290)..(290): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggactcacctgctctggagatgctattcgaccaaacgtntatgcttagtgacagcagacgccggcacggccctgtgtggngatgtaataagacacgtagagacgccctagacgggactcccgtagcgtaccgtatttccgtcgtcgggccttaccggaagggtccggaaggggaacctaaccgggttacaacgtacgttcggacctagttaccgaggtcggagtccgaagggaccgagggaacggacggaaggtcctaggaaactttagttagttagtaactaaactcgaaaacaacgaacctaacctaggtttacggttaaacttagtacgttacgttaacggtaacgttacgaaccggtaaacccgtaaaacggttcccgtacccggttacccgtacgggggttaacccaaccggtaaccccgaaaacccgggtaacccccaaacccccggttaccttaaccggtaccccg

SEQ ID NO: 390542 - DNA, 722 bp, Homo sapiens
  misc_feature: GZ8MTXP02F7M8N.52.86.H09.1.454.CMB.2.raw
  modified_base (290)..(290): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaccgatatgtcttatcggtacagcagaacgccggccacggccctgtgtgganatgtaataaagacactgagacgccctagagggactcccgtaggacgtacgtatttcccctcgtcggtcctaccggtacggtacgaacggggactaaacgggtacacgtagttcggactagtacgagtcggacgtccgaggacgaagggacggaccggaaggtaccgttaggaaactttaacgttttagttacggaaacctaaacttaaccgaaaacaacggaacctaacccgttaagtttaccgggttaatttaacggttgttaccgtttaaccgggaaacttcgggtaacccgtaaaccggttaaaccggttacccgtaacccggtttaccgggtacgggggttaacccaaccggtaaacccccgaaaccccggggaaccccctaaaacccccggtctttaacccggtacccttaacccgttttacccccg

SEQ ID NO: 390543 - DNA, 680 bp, Homo sapiens
  misc_feature: GZ8MTXP02HGD1C.52.86.H09.1.454.CMB.2.raw
  modified_base (223)..(223): a, c, t, g, unknown or other
  modified_base (478)..(478): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaaccgatatgtcttagttacggtaccagcagaacggccgggcccacggcccctggtcgttggtgagtagtaaataaagacagtagaggacggcccctagaggggactccccgtaggacgcgtatttccccgtgttcggctaccggtacggtacgacggggacctaaccgggctaacgtacgttcggacctaacgtcgtaagggtcggacgtaccgagggacaagggacggacggagcgtanacgttattagttagtaacaagtacaaacgacgtaacctaaccgttaagtttaccggttaacttagttacgttacgttaaacggaaccgttacggaacccggtaaaccgtaaacgggtacctacccgggttaccgtcgggtaaccgaccggtaacccgaaaccggaccccctaaacccgacgttactcctaaccgtttccccg

SEQ ID NO: 390544 - DNA, 777 bp, Homo sapiens
  misc_feature: GZ8MTXP02HFB1K.52.86.H09.1.454.CMB.2.raw
  modified_base (224)..(224): a, c, t, g, unknown or other
  modified_base (245)..(245): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccaggacaggacgccaggatcactgctcgtggagntgctaattcgaaccaaacgtnttatgtacttagtcggtaccagcgagaacggccgggaccgacggtccccttggtggttggagtatacggtaaataaacggacacgtggagtaccggccctaggacgggacctccgtagacgtcgtattccccgtcgtacgtcctacgtacgggtacgaacgggaccgtaaacgggtcctaacgtacgttcgggaactacgtacgaagggttcggtacgtacccggaagggacgaaggggtacggaacggggtaacgggtccttaaagggtacctttaaactttaaggggttttacgtaaaacctaactaaaaccgaaacttaaacgggaaacccctaaacccggtttaacgtttaaggggtttaactttaacgggttacgtttaaccggtttaaacgggaacttacgggaacccgtaaccggtaacggttacccggtaaccccgtcggggttacgggtacccaaaccggtaacccccggtaaacggaccccctaaaaccccgtcggttaaccgtcctaaccccggtttcccg

SEQ ID NO: 390545 - DNA, 646 bp, Homo sapiens
  misc_feature: GZ8MTXP02FRO65.52.86.H09.1.454.CMB.2.raw
  modified_base (244)..(244): a, c, t, g, unknown or other
  modified_base (351)..(351): a, c, t, g, unknown or other
  modified_base (631)..(631): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgggagatgctattcgacccaaacgnttatgtacttagttcggtaccagcagaacgccgggccaggcccctgtgttggtgatgtaataaagacacgtggaacgacggcccctagacggggtactccccgtagngcggtatttccctcgtggcctccgtaggtacgaacggggtaccaaaccgggtctaaactacgttcgggacctagtcgaagtggacgtccgaggacgaaggacggacggaggtctaggtaaacttagtttacgttacgtactaaactaccgaaacacgtaacaaccgttagtttacggttaactttagtcgttaccgttacgtaacgttcggtaccgaaccgtaaacggtcccgtaaccgttcgtacgggtaccaacgcccgaaacggccctaaacccgtnttacgactcgttccg

SEQ ID NO: 390546 - DNA, 666 bp, Homo sapiens
  misc_feature: GZ8MTXP02JHSNZ.52.86.H09.1.454.CMB.2.raw
  modified_base (222)..(222): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgganatgctattcgaccaaacgatatgtcttagttggtaccagacagaacgccgggccacggcccctgtgtggtagatagtaagtaaagacacgtggaagacggccctacgagggactcccgtgagacgtattccctcgtcgggcctaccgtaggtacgaacgggtacgaacggtcaacgtagttcggacctagtccgaaagggtcggaacgtcccgaggacgaagggaggaccggaggtacgtagtaaacttagtttacgtacgtaactaaacttaccaaaagacggtaaaccctaaccgttaagtttacgggttaacttagtttaccgggtacgttacgggtaacgttacggaccgtaaaccggtaaacggtacccgtaaccgttcggtacggacgaaccgaacccgaaacgaccccttaaacccgcttaccggactaccttcccg

SEQ ID NO: 390547 - DNA, 590 bp, Homo sapiens
  misc_feature: GZ8MTXP02FET83.52.86.H09.1.454.CMB.2.raw
  modified_base (220)..(220): a, c, t, g, unknown or other
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggcaggatcacctgctctgganatgcattcgaccaaaccgntagtgtcttattggtacagcagaagccgggcacggcccctgtgttggtgatgtataaagacacgtgagacggccctagacgggactcccgtgagcgtattcccgtcgtcggctccgagggtcaggggaccaacgggcaacgtagttcggccatcaaggtggtacgtcccgaggcgaaggacggaccggaggtacctggtaacttattagttgtactaactacaacgacgacaacccgtagttggttaacttagtcgttacgtttacgacgtacgacgacctaaacggtcctaacccgtccgtcgggtacacggaacccgaaacggacccaaccccattcgacctacgtccc

SEQ ID NO: 390548 - DNA, 639 bp, Homo sapiens
  misc_feature: GZ8MTXP02FZYWL.52.86.H09.1.454.CMB.2.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttagttggtaccagcagaacggccgggccacggcccctgtcggttggtgagtagtaataaagacacgtgagacggccctcgagggacctcccgtgacgcgtacttccctcgtcggctccggaggtccgaaggggacgtaaccgggtactacgtagttcggacctagtacgaggtcggacgtacgaggacgaggacgggacggaggctagtacttagttagttcgtacaatactaacaacggaacaaccgtagtttaggtactttacgtacgttacgttacggtaaactcggaccgtaaaccgtacggtaccgtaaccggtcgtacgggtaccgaaccgaaccccgaaaccggtaccccaaaccccgtacggtttaccgaccgttacctttcccg

SEQ ID NO: 390549 - DNA, 632 bp, Homo sapiens
  misc_feature: GZ8MTXP02ISBT7.52.86.H09.1.454.CMB.2.raw
  modified_base (623)..(623): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgagcctcctatgagctgacacagccaccctggtgtcagtcgtcccaggacagaccgcaggactcacctgctcgtaggatatgctattcgaccaaacgatatgtcttagttcgtaccagacaaggaacgcccggccacggtccccgttgtggttggtagtagttagtaaactaaagacacgtaggacgacggccctaggacggtactcccgtaggagacccgtacttccgtacgtcgtcccgtaccgtacgggtccgaaacggggtaaccgtaaaccgggtaccaacgttacgttacgaccctacgttacgaggttacgacggtccgaggacgagacggagagtcagtaattacttatacgtacaaacgtacgaaaacacgtaacaccgtagttacgtactttatacgtcgttacgaacgttgaaccgtacgacggtccaccgtcgtaggccgactacccgaacgaccctaaacccncacgtaccc

SEQ ID NO: 390550 - DNA, 613 bp, Homo sapiens
  misc_feature: GZ8MTXP02FLG04.52.86.H09.1.454.CMB.2.raw
  modified_base (283)..(283): a, c, t, g, unknown or other
  modified_base (285)..(285): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggcaggccctgtgtgngntgtataaagacactgagaggccctagagggactccctgagcgtatcctctgctccgaggtcgagggtaccaacgggtcaactagttcgggaccagttaccgaggttcgggaacgttcccgaaggccgaggacgggacgaggcgtagtaacttatttaagttgtactaattccaaacacggaacctacccgtagtttcggtaactttagtcgttacgttacggaacttcggacccgtaaccgtaacgggttaccaacccgtccgttacggggtccaaccgaaccccgaaacgggaccccaaaccccaacgttcgtaccaccctttcccg

SEQ ID NO: 390551 - DNA, 626 bp, Homo sapiens
  misc_feature: GZ8MTXP02GS5EH.52.86.H09.1.454.CMB.2.raw
  modified_base (288)..(288): a, c, t, g, unknown or other
  modified_base (330)..(330): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaacgatatgcttatggaccagcagaacgccggcacggccctgtgttgngatgtaataaagcactgagacggccctgaggactccgtaganccgtattctcgtcggctaccgaggtcgaacgggacaaccgggtcacgtagttcggaccctaatccgtaaggtcgacgtaccgaggacgaagggacggtacgagggtcctaggtaaacttagtttaacgttacggttaacaaattacgaaaacccgtaaacgtaaccgtaaacgttagttacggttaacttagtacgttacgttacggactcggaaccgtaaaccgtacggtaccgtaccggtcgtacgggtaaccgtaaccggaacccgaacgacccctaaacccgtctacgtacc

SEQ ID NO: 390552 - DNA, 605 bp, Homo sapiens
  misc_feature: GZ8MTXP02H8T1G.52.86.H09.1.454.CMB.2.raw
  modified_base (239)..(239): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccaggcccctgtgttggtgatgtataaagcactgagacggcccacgagggactcccgtagacgcgtattcctcgtggctccgaggtacgacgggacgaacggtcacgtagttcggacagtcaggtggagtcccgaggcaggagggacggaggtcgtagacttagtttagttacgtacaaattcaaacgacgaaaccaccgtaagttacggttaactttagtcgttacgttaccggaaacttcggaccggtaaccgtaacggtacctaacccggtccgtacgggtaccacggaacccgaaccggacccaacccccgtactccggtacctactttcccg

SEQ ID NO: 390553 - DNA, 713 bp, Homo sapiens
  misc_feature: GZ8MTXP02H0BU2.52.86.H09.1.454.CMB.2.raw
  modified_base (225)..(225): a, c, t, g, unknown or other
  modified_base (241)..(241): a, c, t, g, unknown or other
  modified_base (258)..(258): a, c, t, g, unknown or other
  modified_base (284)..(284): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggactcacctgctctggganatgcattgccaaacgntatgctttatggtaccngcagaagccggcaggccctgtgttgngatgaataagacacgtgagaggccctgagggactccctagagcgtattcccgtcgtcggtctaccgaggtcgaacgggacctaaacgggttacacgtaagtttcggaccctattaccgaagttcgggtaagtacccccgagggggaccaacgggaaggggtaaccgggaaggcccgtttaagggacctttaaagtttaactttaggttacaaaacgtttacaaaacgacggaaacctaaccgtaaagtttagggttaaccctttaagcggtttacccttaacggggaactttccggaaccggtaaccctaaaacgggttccccgaaacccggttccggtttaccggggtaccaaaccgtaaccccccggaaaacggggtacccccaaaaacccccctggtttacccgaacccgttaacccttcccccgg

SEQ ID NO: 390554 - DNA, 636 bp, Homo sapiens
  misc_feature: GZ8MTXP02IA3LE.52.86.H09.1.454.CMB.2.raw
  modified_base (238)..(238): a, c, t, g, unknown or other
  modified_base (279)..(279): a, c, t, g, unknown or other
tcagcgcagtacgacacgaccggtgctcgatttagtgctatagacttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggcagacggccaggatccacctgctctggagatgcattgaccaaacgntatgcttatggtaccagcagaagccgggccaggccccttgngttgtgatgtactaaagcactggagacggccctgagggactcccgtgagcgtattccctcgtcggctccgtaggtccgaagggcctaaaccgggttcaaaccgttagttacgggaccctatcgacgttggacgtccgacggacgaggaacgggagacggccgtaggtacttaagtttacgtttagttaacgaaactttacaaaaccgtaacggtaaccaacccgtaagtttaggtttaactttagttacgttacgtacgggtaaaactcggtaccgaaccgtacggtaccaccggttccgcggttaccgaacgtcccgaaacggtcccaaaaccctccgtacgtacctacgttcccg

SEQ ID NO: 390555 - DNA, 742 bp, Homo sapiens
  misc_feature: GZ8MTXP02FRHB1.52.86.H09.1.454.CMB.2.raw
  modified_base (265)..(265): a, c, t, g, unknown or other
  modified_base (270)..(270): a, c, t, g, unknown or other
  modified_base (318)..(318): a, c, t, g, unknown or other
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttgggttttcctcgttgcttcttttaagaggcgtccagtgtcaggtgcagctgggtggaggtcggtggggggggctggtccagggcgtgggaggtccctgagactctcctgtgcngcctntggtattccaccttcacgtacccatagaaatcgacacgtcgggtcccnccgacggcctaccgaggacgaaggggtcgtggggaggtggggtcgacgtaggttatacgtccctagtgaagtaggaagactaaatacggacaacgtacgacgagtacggtaccgggtaggaaacgggcgtaacgttacgaacctagttcccgtaccgaagaaacgaaacctaaacgtaaccggaaagttaaacgtttaaccggtttactttaaaccgtaaaacaaaacgttaacggaaacctaacggacccgtaagggaagtaacggtaccgtaaggaaacgggaaaccgtaccgggttacctttaaagttttccggtttttaaacgggtacgggttaccgggaacgggtaaacgggtaaaccggtaaaccgttaacggttaaacgtaaccgacggtaaccgtaacccggtaacccgtaaacgg

SEQ ID NO: 390556 - DNA, 594 bp, Homo sapiens
  misc_feature: GZ8MTXP02GUIY3.52.86.H09.1.454.CMB.2.raw
  modified_base (295)..(295): a, c, t, g, unknown or other
  modified_base (447)..(447): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggactcacctgctcgtggagatcgctattcgaccaaaccgatactgtcttaattcggtaccagcagaagccggccaggccctgtgtggngatgtaataaagacatgagagccctgaggtactcctagagtcattccgtctcgctccgaggttcgagggaccaacgtcacgtagttcgactagtcgtagtggacgtcgaggacccgagacgggacgaggtcgtagacgttagttagttctanaacgtacaaacgcaacgacctagttacgtacgttagtagttacctaggaaccgtgtacccgacgtaaaccggtcaacccgttcgttacggaccgtaaccaaccggaaacccgtacccaaaccccgtcgtcgtaccctacgttccccg

SEQ ID NO: 390557 - DNA, 652 bp, Homo sapiens
  misc_feature: GZ8MTXP02GCBY4.52.86.H09.1.454.CMB.2.raw
  modified_base (298)..(298): a, c, t, g, unknown or other
  modified_base (641)..(641): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcacctgctctggagatgcattcgaccaaacgatatgtacttagttcggtaccagcaaggaacgccgggaccacggcccctggtgttggngatgtaataaagcagtgagcgccctgagggactcccgtaggacgtcgtatttcccgtcgtaggtcctacggagggtaccggaacggggacctaaaccggggtcctaacgtagttccggaccctaagtcgaaggttggaacgtcccgaagggacctaggggaacggaccggagggaccttaggtaaacctttaagtttaaagttggtaacctaaacgttacaaaaccgtaacggtaaaccctacctaaggtttacggtaactttaacgtgttaccgttacggaaacttcggaccgtacgaacgtaccgtaccgtcgtacggtcacgcccgaacgcccaaacccntcgactctccc

SEQ ID NO: 390558 - DNA, 767 bp, Homo sapiens
  misc_feature: GZ8MTXP02FO9VL.52.86.H09.1.454.CMB.2.raw
tcagcgcagtacgacacgaccggtgctcgatttagtgctatagacttgggtttggggctgggagacgagcccagcactggaagtcgccggtgtttccattcggtgatcatcactgaacacagaggactcaccatggagtttgggctgagcttgggttttcctcgttgcttcttttaagaggcgtccagtgtcaggtgcagctgggtggaggtcggtggggggggctggtccgagggcgtggggaggtccctggagactctcctgtgcacgcctctggattccaccttcacgtacccatagaaactgccacgtcgggtcccgccaaggcctccgaagggcgaaacggggggtctaggggaggtggggtcggacgaaggtttactagttcccccgtaagttgaagttaaggggaaagacgtaaaacgttaaggccaaacgttaacgaccgaaggacggttacccgggtagggaaacgggggtacccgtaaacgtttcggaaacccgtacttaccgtacccgaacgggtaaacgaaaacccgtaaacgtaacccggaaaaaggtaaaaccggttttaaaccgggtttaccctttaaaccgtaaaccgtaaaaagttaacggaaaaccgtaaaccggtcccgtaaggtaaaggacggtacgtaacgagggtaaaccgacggtaccttaagtttacggtttaaacgtggtacgtacgggaaggtaacgggtaaaccgtaggtaacttacgacgacgacgtacccgtaaacgg

SEQ ID NO: 390559 - DNA, 596 bp, Homo sapiens
  misc_feature: GZ8MTXP02FF6PR.52.86.H09.1.454.CMB.2.raw
  modified_base (289)..(289): a, c, t, g, unknown or other
  modified_base (296)..(296): a, c, t, g, unknown or other
tcagcgcagtacgacacgaccggtgctcgatttagtgctatagacttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgacccaaaccgattatgcttattggtaccagcagaagccgggccaggcccctgtgtggnatagtanaaagacactgagacggccctgagggactcccgtgagcgtattccctcgtggctccgaggtccaggggaccaaacgggtcaactagttcgaccaattcaaggtaggacgtcccgaggacaaggaggaccggaggcctagacttattatgacaatcaacagacaaccctatttaggtaactttagtacgttacgtttacggaaactcggaccgaacctaaacggggttccaacccggttccgtacggggcaaaccggcccgtaaaacggcccccaaaacccctctacgtacctcttacccgg

SEQ ID NO: 390560 - DNA, 571 bp, Homo sapiens
  misc_feature: GZ8MTXP02IFJ7R.52.86.H09.1.454.CMB.2.raw
  modified_base (241)..(241): a, c, t, g, unknown or other
  modified_base (373)..(373): a, c, t, g, unknown or other
  modified_base (558)..(558): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtgtccccccaggacaggacggccaggatcacctgctctggagatgcattgaccaaacgntatgcttatgtaccagcagaacgccggcacggcccctgtcgttggtgatgtataaagcactgagacggccctagagggactcccgtgacgcgtattcccgtctcggctcgaaggtcgaacgggtacacggtnaccgtagttcgccatcagtggagtaccgagaccgagaaggtacggaagcgtagtacttattatttagacaattacaaactaacaccacctagtttacggtactttaagtcgtacgtttacggactacggacgaaccgtagtaccgaacgttccgcgggtacaccgaaccgacggaccccaaccgntacgctacgtccc

SEQ ID NO: 390561 - DNA, 655 bp, Homo sapiens
  misc_feature: GZ8MTXP02JKHE9.52.86.H09.1.454.CMB.2.raw
  modified_base (300)..(300): a, c, t, g, unknown or other
  modified_base (453)..(453): a, c, t, g, unknown or other
  modified_base (482)..(482): a, c, t, g, unknown or other
tcagcgcagtacgacacgaccggtgctcgatttagtgctatagacttgggtttgggggtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggccaggatcacctgctcgtggagatgcattcgacccaaaaccgatatgtcttagttcggtaccagcgagaacggccggccacggccctgtggttggtnatagaataaagacacgtggagacggccctagagggtactcccgtgacgcgtacttccgtcgcgtctaccggtaggtccgaggtaccgaaccggtacaactgttcggacctagttaccaaggtggaaacgtcccgaaggcgaaggtacggacgngggactagggtaactagttatcgttaaanaactaacaactaacgaacctaacgttaagtttacgttaacttagtacggttactacgtaacgtacggtaaccggtaccggtaaccggttaccggtacccgttaccggtacgggtaaccaacccggaacccgaaccgtaacccccgaccctagtaccgttacctaccgttaccg

SEQ ID NO: 390562 - DNA, 750 bp, Homo sapiens
  misc_feature: GZ8MTXP02HEU5L.52.86.H09.1.454.CMB.2.raw
  modified_base (179)..(179): a, c, t, g, unknown or other
  modified_base (251)..(251): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctgggtntcaggtcgtccccaggacaggacggccaggactccacctgctcgtggaagatgcagttcgacccaaaacgtntatgtacttagtacgacagacgacggacggccggaccgaccggtcccgttggttggttggtagtagtacgtaaacgtaaacgacgtacgtaggaacggaccggtaccgtacggaacggtcctaccggtagacgtacgtactccgtcgtacgccgtacggaggtacggaacggtaccgtacgtacacgtcgtacgactagtacgaggtcggtacgtacgaggacgaacggggaggacggaacgtacgtaacgttaacgttagtttataccgtaaactaacgttaaaccgaacgtaaccgtaaacctaacgtttaacgtttacggttaaactttacggttacggttaccgttaacggtaccgttaccgggaaaccgttaaaccggttacggtacccgtaaccgggttaccggttacgggtaaccccgaaccccggtaacccgtaaacccggtaaccccctaaaccgtaccggttacccgtaaccggttacccgtttccccg

SEQ ID NO: 390563 - DNA, 691 bp, Homo sapiens
  misc_feature: GZ8MTXP02IA0TZ.52.86.H09.1.454.CMB.2.raw
  modified_base (246)..(246): a, c, t, g, unknown or other
  modified_base (256)..(256): a, c, t, g, unknown or other
  modified_base (258)..(258): a, c, t, g, unknown or other
  modified_base (313)..(313): a, c, t, g, unknown or other
  modified_base (350)..(350): a, c, t, g, unknown or other
  modified_base (378)..(378): a, c, t, g, unknown or other
tcagcgcagtacgacacgaccggtgctcgatttagtgctatagacttgggtttggggctgggagacgagcccagcactggaagtcgccggtgtttccattcggtgatcatcaactgaacacagaggactcaccatggatttgggctgagctgggttttcctcgttgctctttaagaggcgtccagtgtcaggtgcagctgggtggagtcggtggggggggctggtccaggcgtgggacgtcctgancgtctctgtncncgcctcgtggacttcaccttcacgtacccatagaaatggacctacgttcgggccnccgaggcctccgaggcgaaggggctgggaggtcgggngactagttatctccctagtgataggaanacgtaaaatacggactaacgtacggacaaggtacggtaccggtagggaaacgggcgactttacggaacctcgtaacctacccgaagaaacgaaaccgtaacgtaaacgggtaattaaaccggtttaccggtttactaaacctaaacgtaacgtaaccgtaaacgccgttacgaacggtaggtacggtacgaggtaaacggacccgtaggttaacgtttagtttacgtttaacggtacggtacggtaacggtaacgggtaaccgttaacgtaacgttaacgacggtaaccgtaccgtaaccggtaccgtaaacg

SEQ ID NO: 390564 - DNA, 678 bp, Homo sapiens
  misc_feature: GZ8MTXP02FNEOO.52.86.H09.1.454.CMB.2.raw
  modified_base (226)..(226): a, c, t, g, unknown or other
  modified_base (662)..(662): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacgccaggactcacctgctcgtgganatgactagttacgacccaaaccgtattagtcgtacttagttacggtaccagacgagaacggccgggccgacggtcccctggtggttggtgtactagtaaagtaaagacgacgtggtaagacggacccgtacgaacgggtactcccgtagagcgtattcccgtacgtcggtctaccgtaggtcgaaggggtaccgtacggtacactagttcgactatacgtagggtcgggtccgagcgtaggacggacgaggactagtaacttagttaacgttggtaacaagtaccgaaacgtaacgtaaccgtaaccgttaaagttggttaacgtttagttacgttccgttaacgacgttacgaaccgtaaccggtaacgtaccgtaccggttaccgtacgggtaaccaaccggtacccgaaccgaccctaaccctacgtcgtacnccgtacctttaccccg

SEQ ID NO: 390565 - DNA, 524 bp, Homo sapiens
  misc_feature: GZ8MTXP02I52PO.52.86.H09.1.454.CMB.2.raw
  modified_base (241)..(241): a, c, t, g, unknown or other
  modified_base (288)..(288): a, c, t, g, unknown or other
  modified_base (298)..(298): a, c, t, g, unknown or other
  modified_base (314)..(314): a, c, t, g, unknown or other
  modified_base (327)..(327): a, c, t, g, unknown or other
  modified_base (335)..(335): a, c, t, g, unknown or other
  modified_base (371)..(371): a, c, t, g, unknown or other
  modified_base (376)..(376): a, c, t, g, unknown or other
  modified_base (408)..(408): a, c, t, g, unknown or other
  modified_base (414)..(414): a, c, t, g, unknown or other
  modified_base (419)..(419): a, c, t, g, unknown or other
  modified_base (438)..(438): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagtccaccctggtgtcagtcgtccccaggacagacggccaggatcacctgctctggagatgcattgacccaaacgntatgcttagtggtaccagcaggaagccggcctaggccctgtgtggtnatgaataaanctatgacgtcgccctnaggactcctagcngtattccncgtgctcgaggtcaggcacgtcatcgtgacatcagngtacncgagcgagtgacgagtcagactattatacgtnaacgtnaaccngaacacaagttgacttagnttacgtggaacctgacgtaacacggttacgaccgttccgaagggcaacgcccgaagaaccctacccgagtactccaacgtttcccg

SEQ ID NO: 390566 - DNA, 689 bp, Homo sapiens
  misc_feature: GZ8MTXP02GC4YA.52.86.H09.1.454.CMB.2.raw
  modified_base (245)..(245): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctggagatgctattcgaccaaacgntatgtacttattggtaccagacaggaacggcccggaccacggcccctgtgttggtgatgtaataagacagtgagacgccctgacgggactcccgtgacgccgtacttcctcgtcggctccgagggtccgaacggggaacctaacgggtctaacgtagttacgggccctaagttccgaggttacgggaacgttacccgaagggacgaacgggaacggggaacggtaacgggtaccgtagtaaaccgtttaagtttaacgtttacgtaactaaacttaccggaaaaccacggtaaaccaacccgttagtttacggttaactttagttcgtttaccgttacggacttggaaacccgtaaccgtaaacggttcccgtaccccggtacgtttacggggcctaaccggacccgtaaaccggaccccctaaccccgtacgtccgttaaccc

SEQ ID NO: 390567 - DNA, 694 bp, Homo sapiens
  misc_feature: GZ8MTXP02IRN5X.52.86.H09.1.454.CMB.2.raw
  modified_base (324)..(324): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgtacttattggaccagcagaagccgggccacggcccctgtgtggtgatgtataaagacactagagacggccctagagggntcccgtagacgcgtacttctccgtggtctccgaggtccgaaggggaccaaacgggtcaacgtagttcggacctagtcaaggtggacgtacgacggacgaagggaacggacggaacgggtccgttaagggaaaccttttaatttaaacgtttcggttaacgtaaacttaccgaaaacgtaacggaaacccaaccctttaaggtttacgggtttaaacctttaaagttccggttaaccgttcggggtaaaacccttcgggacccgtaaaccgtaaacggggttcccaaacccgggttccgtacgggggtacccacggtaaccccgaacgggaccccctaaccccgaacggtttcccgacgttaacttccccg

SEQ ID NO: 390568 - DNA, 726 bp, Homo sapiens
  misc_feature: GZ8MTXP02GSUPD.52.86.H09.1.454.CMB.2.raw
  modified_base (223)..(223): a, c, t, g, unknown or other
  modified_base (243)..(243): a, c, t, g, unknown or other
  modified_base (287)..(287): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacgccaggatccacctgctcgtgganatgctattcgaccaaacgtntatgtcttagtggacagcagacgccggcgacgtcctgtggtgtnagtagtaataacgactagtagacgcgtacctgacgggactcccgtagacgctacttccctcgtcgtcctaccggtaggtaccgaagggtacccgtacggtaccaacgttacggttaccggacctaagtcggaaacggtacgggtacgaccgagggaccgaaggggtaaccggacgggtacggacgttaacgttaaccgtttaactttaggtttccgaaactaaacgttaaccgaaacgaacgtaaaccccgtaccgttaagtttacggtttaactttacgttcggtttaacgttaccggtaagtacccggtaaccggtaaaccggttaaccggtacccgttaaccgggtttcccgacgggtaacccttaaacccggaaccccgaaaccggtacccccaaacccggttaacgtcccttaacccggtactttaccccccgg

SEQ ID NO: 390569 - DNA, 680 bp, Homo sapiens
  misc_feature: GZ8MTXP02JWXWU.52.86.H09.1.454.CMB.2.raw
  modified_base (225)..(225): a, c, t, g, unknown or other
  modified_base (229)..(229): a, c, t, g, unknown or other
  modified_base (248)..(248): a, c, t, g, unknown or other
  modified_base (360)..(360): a, c, t, g, unknown or other
  modified_base (377)..(377): a, c, t, g, unknown or other
tcagcgcagtacgacacgaccggtgctcgatttagtgctatagacttgggtttgggggctgtgggtccaggaggcagaactctgggtgtctcaccatggcctggatccctctacttcctccccctcctcactctctgcacaggctctgaggcctcctatgagctgacacacgccaccctcggtgtccagtcgtccccaggacaggacgccaggatcacctgctcngganatgctatcgacctaaacgntatgtacttattcggacagtacaagaacggcccggaccaccggtccccgtggttaggtttggtagagttacggtaataacgactacgtggagaccggccctagacgggtacnccgtagacgtacccgtnttctcgtcggctaccgaggtcgaacgggtaaccacggttacacgtacggtcgccagtcgaggtaggacgtccgaaaggggacgtaacggacggtacgtagcgtacgttacgttagttacgttacgtaacgtaactaactaaacgtaacgtaaccgtaacgttaacgttaacgtttaacgtttacgttacgttacgttaccggtaacgtacggtaaccgtaaccggtaaccggtaccgtaccggtaccggtacggtaacgtaccgaacccgtaccgaacccgtaacccgtaccgtaccgtaccg

SEQ ID NO: 390570 - DNA, 674 bp, Homo sapiens
  misc_feature: GZ8MTXP02HSLCA.52.86.H09.1.454.CMB.2.raw
  modified_base (218)..(218): a, c, t, g, unknown or other
  modified_base (222)..(222): a, c, t, g, unknown or other
  modified_base (367)..(367): a, c, t, g, unknown or other
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctggtgtcagtgtccccaggacaggacggccaggatcacctgctcngganatgctattcgacccaaaacgattatgtacttagttcggtaaccagcaaggaacggcccgggccacggtcccctggtgttggtgtatgtaaataaagacagtagagacggtcccctgagggtactccgtgacgcgtattccccgtntcggcctcgagggtccgaaggggacctaaacgggtctaactacgtttcgaccctattccggagttcgggaacggtcccgaaggggaccgaagggaacggggtacggacgggtaccttaggtacctttaagttatttacggtactaaacgttaccaaaactaacggaacctaaccgtagtttaggttaacctttagtcgttacgtttacggaaacttcggaaccgtaccgtaaacggtccaaccggttccgtacgggtccacgaaccccgaaacggacccctaacccagttacccgctacctttcccg

SEQ ID NO: 390571 - DNA, 759 bp, Homo sapiens
  misc_feature: GZ8MTXP02JG17T.52.86.H09.1.454.CMB.2.raw
  modified_base (181)..(181): a, c, t, g, unknown or other
  modified_base (224)..(224): a, c, t, g, unknown or other
  modified_base (227)..(227): a, c, t, g, unknown or other
  modified_base (247)..(247): a, c, t, g, unknown or other
tcagcgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctggtntcaagtgtcccaggacagacgccaggatcacctgctcgtgganatnactattcggacccaaacgtnttagtcgtactttaagttcggtaaccagtacgaaggaacggccccgggaccgaaccggtcccctggttacggtttggtagtaattagtaaattaaacgacctacgtaggaacggtaccgggcccttacggaaacggggtcttaccccgagacggtacccgtactttccgtctacggggtcccttaccggacgggtcggaaacgggaccgtaaaccggttccaaacgtagtttacgggaccctaaagtcgaagggttacggaaggtcccgaaagggaccgaaggacggggaacggacgtacctaagggtaactagtttaaagttcgtaaacctaataacccgaaacgaccgtaaactaacccgttaagttttaccgggtaactttaacgtagttacccgtaacggttaaacgcgtaaaccggaaaccgtaaccggtcctaaccccgggttcgttaacggaacccgaacgaccccggaaccggtaaccccaacccgtaccggtaccttaacccg

SEQ ID NO: 390572 - DNA, 708 bp, Homo sapiens
  misc_feature: GZ8MTXP01CB7UU.9.19.B08.1.454.CMB.2.raw
  modified_base (255)..(255): a, c, t, g, unknown or other
  modified_base (271)..(271): a, c, t, g, unknown or other
  modified_base (326)..(326): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtcgtcggggccccagggcagagggtcaccatctcctgcactggcagcagttccaacagtcggggcaggttangatgtccatggtaccngctagtttccaggaaccacgcccccaggtcctctattcgtttagtacagttaacnccggccctcgaccggggtccctgaccgtattctcgtcggtcctaccaaagttcctcgacctaccctcgacgtcccctcccgtcggaccctaactcccgtaacggtcggggtacccttaccgaacgtacccgttagggaacgggtaagttcgggaacgggggtcctttaaccgtaaagttttaactttaaaccgtcggtaccctaaggtttacctttaacgtacggaaaacctaaaacgttcgaaaaccggttaaacgttagggtttttacggggttacggtttaccggggaaccggggttaaacgggttacccgaaacggtccgtaaccggtaaccccggtttcccaccggttaccggttaaccgaacccgtaacccccggg

SEQ ID NO: 390573 - DNA, 621 bp, Homo sapiens
  misc_feature: GZ8MTXP01EG54Z.9.19.B08.1.454.CMB.2.raw
  modified_base (261)..(261): a, c, t, g, unknown or other
  modified_base (294)..(294): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacgagggtcctgggcccagtctgtgctgacgcacgcccgccctcagtgtcgtcggggccccagggcaggacggtcaccatctcctgcactggcagcacgttaccaacagtcggggcaggttangatcgtccactggtaccagcagtttccagaacncgcccctaggtcctctattctttgtacagtacgtcgcccgtcgaccgggtcctgaccgtattcctcgtggtcctactaacgtctcgaacctacctcgtacgcccttcccgtcggacccactccgacgtcgggtacctccgaacgtaccgtggaagtagtacggtacggggtacttacgtatttaacgttaacctcggtacctaaggtttccttaaagtacggaaactaaacgtctaaacgtaacgttggtttaggggttcggtacggggtaccgggttacgggttaccaggtccgtacgtccgtaccgtcgacgtcgcgtaaccccg

SEQ ID NO: 390574 - DNA, 666 bp, Homo sapiens
  misc_feature: GZ8MTXP01B2UVW.9.19.B08.1.454.CMB.2.raw
  modified_base (257)..(257): a, c, t, g, unknown or other
  modified_base (295)..(295): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtggggccccagggcagagggtcaccatctcctgcactggcagcagttccaacgagtcggggctaggttangatcgtaccactcggtaccagctagtttaccagtaacncgcccccaggtcctctattcgtttaggtacagtaactccggccctcgtaccggggtcccctaggacccgtatttccgtcgtacggcccttaccgtaaagtcctacgtacccacccttccgaccgtcccttacccgtcggaccctagtcctaccggttcgggaccttacccgagacgttagacggtagtaccggaggggtacccttagtaactttaacgttacgtaccgtcccgtagttaccttagtaccgtaaactaaacgtcaaaggtaacgttaggtttcggggttacggttaccggggacggggacggttaccaacgggtcttaccggtaacccgttcccgagttaccggtcgaaccggtaaccccgg

SEQ ID NO: 390575 - DNA, 716 bp, Homo sapiens
  misc_feature: GZ8MTXP01DMLZ0.9.19.B08.1.454.CMB.2.raw
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcgggccccagggcagaggtcaccatctcctgcactggcagctacgttaccaacagtcgggagtacgttagtgaatgtcctacgtacgtacgacgctacgtttaccgtaacgaacgtaccgcccccgtaccggtcgtacctacttcgttttacgttacgtaactacgtccggtcccgtccgtacccgggtacccgttcgtaccgtacttccgtccgttcgtccgtacctaaccgtacttcgaccctacctcgaaccctccctcccgtccgcgtactacctaccgtacggtccgttacccgacgtaccgttaggacggtaaggtaccgtagggggttacttacccttaatttaaaccgtttacgtaccggtcttacggttaactttaacgtaccgtaaaccgtaaaaccgtacggtaaacgttaacgttaacgggtttggggttaggttaccggggtacgggttaacgggaccgttaacgaaccgttaccgtcccgtaccgtccgagttaacccgaacgtaacccccggg

SEQ ID NO: 390576 - DNA, 728 bp, Homo sapiens
  misc_feature: GZ8MTXP01EA47U.9.19.B08.1.454.CMB.2.raw
  modified_base (180)..(180): a, c, t, g, unknown or other
  modified_base (263)..(263): a, c, t, g, unknown or other
  modified_base (285)..(285): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctnagtgtcgtcggggccccagggcaggaggtcaccatctcctgcactggctagctacgttaccaacgagtcggggctaaggttanggatcgtccacgtcggtaaccngtacctacgtttaccaacggggaaccaccggtcccccgtagggttcccctacgtacgtttccgttttaggtaactagttaacgtccggacccgtcggtacccgggtccctagaccgtattcccgtcgttcggcctaccgaaagttccctacgtaaccctaccttcgacccgtccctacccgtcggaccctacgtaccgacgttccgggaccttacccgaagtaccgttaggaacggtagtacggtacggggtacttacgttaactttaacgttaccgtcgtccgttaagtttaccttaacgtacgtaaaccgtaaacgttccgtaaacggttaacgttacggttttggggttacgttaccggggaacgggttaacgggttaaccttaacggtcccgttacggtaaccccgttacgtcgacgtaacccgttaaccggaaccccg

SEQ ID NO: 390577 - DNA, 613 bp, Homo sapiens
  misc_feature: GZ8MTXP01CEJIV.9.19.B08.1.454.CMB.2.raw
  modified_base (180)..(180): a, c, t, g, unknown or other
  modified_base (257)..(257): a, c, t, g, unknown or other
  modified_base (295)..(295): a, c, t, g, unknown or other
  modified_base (312)..(312): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctnagtgtcgtcggggccccagggcaggaggtcaccatctcctgcactggcagcacgttccaagagtcggggcaggttangatcgtccacgtggtaccagctagtttccaaggaaccnccgcccccgaggtcctntactttcgtttagtacagttacgtccggccctcgaccggggtccctagacctattctcgtcggctaccaagtctacgaccaccgtcacgtccctaccgtcggcctacgtccacgtcgggcctaccgaggtacgtagacggatcggacggtcttacttatttacgtactcgcgtagttctactacgaactaacgtgtaaactaacggttggtttcggggttcggttacggggacgggaaccgggttaccaacggtccgtccgtaacccgtccgtaccgttacgtcccgaaccgtaaccccgg

SEQ ID NO: 390578 - DNA, 589 bp, Homo sapiens
  misc_feature: GZ8MTXP01C2EEW.9.19.B08.1.454.CMB.2.raw
  modified_base (254)..(254): a, c, t, g, unknown or other
  modified_base (530)..(530): a, c, t, g, unknown or other
  modified_base (539)..(539): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtcgtcggggccccagggcagaggtcaccatctcctgcactggcagcagttccaacagtcggggcaggttangatgtccactggtaccagctagtttccaggaacacgacccccagggtccctacacttcttttaggtaacagttaaactccggccctacgaaccgggggttcccctaggaccgtattccgtaactcgggcctacccaaaggtcctagacctaccctcgacgccctcctcggaccactcacgtaggcctacgagtacagagacgtgagggcttactaattattacgtcgaccctagttacttagtacgaacaaacgttcaagtaacttaggtttgggnggttacggnggttacgggcagtcctgaacccgttcacgttacgtccgaacgaaccccgg

SEQ ID NO: 390579 - DNA, 634 bp, Homo sapiens
  misc_feature: GZ8MTXP01CO8EL.9.19.B08.1.454.CMB.2.raw
  modified_base (245)..(245): a, c, t, g, unknown or other
  modified_base (261)..(261): a, c, t, g, unknown or other
  modified_base (278)..(278): a, c, t, g, unknown or other
  modified_base (305)..(305): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcaggaggtcaccatcctcctgcacgtggcagctacgttccaacngtcggggctaggttangatcgtccactggaccngctagttccagacacgccccaggtccntattcgtttagtacagtaacgtccgcctcgaccgggtcctagaccgtattctactcggcctactaacgtcctacgaccaccttcacgtccctcctcggccacgtccaacgtcggcctacgacgacgtgaacggtagtacgacggggtacttactaatttacttaacgtcgtaccctaggttacttaagtcgaaaccgtaaacgtacaacggttaacttagggttttcggggttaacggttacggggtaacgggaaccggttaccgaaccggtccgttaccgggtaacccgtttccgtaaacgccgttaaccggaaccgtaacccccggg

SEQ ID NO: 390580 - DNA, 738 bp, Homo sapiens
  misc_feature: GZ8MTXP01AF1W5.9.19.B08.1.454.CMB.2.raw
  modified_base (257)..(257): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgcctcagtgtcgtcggggccccagggcaggaggtcaccatctcctgcactggcagcacgttccaacagtcggggacaggttanggatcgtccacgtcgggtaccagtcgtacgtttccgaacggtaaccaccgccccccgtaggggtccctacgtattccgttttacggttaacaggttaaactcccgggtacccctcgggtaacccggggttcccctaggtacccgttacttcccgttaccggttcggtcccgtcccgtaaacgggtccttaccgtacccgtaccctacccgtacccgtcccccgttcccgttccgggaccctacgtacctaccggtcggggtaccctccgaacgtaaccggttacggaagggtagttcgggaaacgggggtcttaaccgtaagttttaacttaaccgtcgtaccgtaggttaccttaaacgtacgaaacctaaaccgtcgaaacgtaaacgttggtttacgggggttcgttacggggaacgggttacgggacgttaacgtcgtacggtaaccggtacctcggacgtcgaaccggtaacccgg

SEQ ID NO: 390581 - DNA, 659 bp, Homo sapiens
  misc_feature: GZ8MTXP01AVH3N.9.19.B08.1.454.CMB.2.raw
  modified_base (256)..(256): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtcgtcggggccccagggcaggagggtcaccatctcctgcactggcagcagttccaacgagtcggggcaggttangatcgtccacgtggtaccagtctagtttccgaaggtaaccaccggacccccgtagggtcctacgtacgttccgttttaggttaacagttaacgtccggtccctcggacccggggttcccctaggtacccgtacttccgtcgtcggcctaccgtaaacgttcctcgaaccctaccctcgacccgtcccctcccgtacggtacctaacgtccgacggtccgggaccttccgacgtaccgtaggacgtacgtacggacgggtctacgtaactttacttaccgtctacggtacttacgtaacgtacgtaaaccgtaaacgtcgtaacgtaaacgtttggttagggttcggtacgggtacggacggttacaacggtcacggtccgtcacgacgtcgttaacgaacccg

SEQ ID NO: 390582 - DNA, 589 bp, Homo sapiens
  misc_feature: GZ8MTXP01B7B7P.9.19.B08.1.454.CMB.2.raw
  modified_base (251)..(251): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagaggtcaccatctcctgcactggcagcagttccaacatcggggcaggttangatgtccactggtaccagcagtttccaggacagcccccagggtcctcatctttggtacagtaatcgccctcgacgggtccctgacctatctctgctcaagtctcgacactcacgccctcctcggtccatcacgtcgggcctaccgacgaccgtgaaggagttaggacggggcttacctaatttaacttaccgtgcctacggttactttatacgtaaaccgtaaacgtcaaacggaacttaaggttttggggttacggtttcggggacgggttaacgggaccgttaaaggtccctaacggtaacccgttccgtacgacgttaaccgaaccgaaccccgg

SEQ ID NO: 390583 - DNA, 524 bp, Homo sapiens
  misc_feature: GZ8MTXP02F5WJA.9.19.B08.1.454.CMB.2.raw
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagccccaaagtcatcatttatgacaacatgaagccggccctcgaggggtccctgaccgattctccggctccaagtctggcacatcacgccctcctggcccatccactgggctccgagctgaggatcgaggctgactattactgaccagtcgtatcgaactagttcgggaccttaaaggtaacacgttcgtcttacggaaacgtcggggaaaccaagggtccaaccggtccgtggggtaccc

SEQ ID NO: 390584 - DNA, 494 bp, Homo sapiens
  misc_feature: GZ8MTXP02F7SWR.9.19.B08.1.454.CMB.2.raw
  modified_base (416)..(416): a, c, t, g, unknown or other
  modified_base (425)..(425): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccaggtcctcatctttggtacagtaactcggccctcacggggtccctgaccgattctctggctccaagtctagccactcagccctccctgccatcactcggctccagctgagatgagctcattatacngcagtctangaacaagtcagaactagtttgggtgttcggcggaggaccaagcgtcgacctcctcgacgtcgacacccg

SEQ ID NO: 390585 - DNA, 498 bp, Homo sapiens
  misc_feature: GZ8MTXP02FTL4G.9.19.B08.1.454.CMB.2.raw
  modified_base (431)..(431): a, c, t, g, unknown or other
  modified_base (483)..(483): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccaggtcctcatctttggtacagtaatcggccctcacggggtccctgaccgattctctggctccaagtctgacacctcacgccctccctggccatcactgggctccagactgagatgaggctcattattactgccagtcttangacaaacgtcagactattaggtgttcggcggtaggacaagcgtcgaccgtcnctacgtcacgacccg

SEQ ID NO: 390586 - DNA, 558 bp, Homo sapiens
  misc_feature: GZ8MTXP02F8PAT.9.19.B08.1.454.CMB.2.raw
  modified_base (252)..(252): a, c, t, g, unknown or other
  modified_base (439)..(439): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagcccgccctcagtgtctggggccccagggcagagggtcaccatctcctgcactggcagcagttccaacatcggggcaggttangatgtccactggtaccagcagtttccaggaacacgcccccgaggtcctcattctttggtacagtaatcgcctcgacggggtccctgaccgtattctctcggctccaagtctgaccacctcacgccctcctgccatcactcggctccgagactgagatgagctacattatactcgacctagtcttaanacgaactaaacgtactaagtaacgttaggtttacgggttacggttaccggggacgggaaacggtaaccgaacggtccgtaccggtaacccgttccgtacgtacgtaccgaaccgacccg

SEQ ID NO: 390587 - DNA, 568 bp, Homo sapiens
  misc_feature: GZ8MTXP02I6TIY.9.19.B08.1.454.CMB.2.raw
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctcggggccccagggcagagggtcaccatctcctgcactggcagcagttccaacagtcggggcaggttatgatcgtccactggtaccagcagtttccaggaacacgcccccgaggtcctcattcgtttggttacagtaactccggcctcgaccggggtccctgaccgtattcctcgtcggtcctaccgaagtcctacgacctacctcacgtccctccgtcggccatcacgtcggcctccgagtactgagatggagctgtaattactacgcgtacctagttccgttaatacgaactaaacgtcaaagtacgtaggtttcgggtcgttacggacgggtaacggacccgaaagtccgtacgaccgtcctacgacgtccgacgacccgg

SEQ ID NO: 390588 - DNA, 557 bp, Homo sapiens
  misc_feature: GZ8MTXP02GNOZ8.9.19.B08.1.454.CMB.2.raw
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtctggggccccagggcaggagggtcaccatctcctgcactggcagcagttccaacagtcggggcaggttatgatgtccactggtaccagcagtttccaggaacacgcccccaggtcctcattcgtttgtacagtaactcggccctcgacggggtccctagaccgtattctctggcctccaagtctcgaccacctcacgtccctccctcggcccatcacgtcggcctccgagacgtgagatggacgctactattactactcgacctagtaccttaatacgaactaaaacgtacaacgtaacgtagttttgggtcggttacgggcggaacgggaaccctaagcgtacgaccgtcctacgacgtacgacgaacccg

SEQ ID NO: 390589 - DNA, 503 bp, Homo sapiens
  misc_feature: GZ8MTXP02JK6AI.9.19.B08.1.454.CMB.2.raw
  modified_base (410)..(410): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggtatgatgtccactggtaccagcagtttccaggaacacgccccaggtcctcatctttggttacagtaatcgcctcgacgggtccctgaccgattctctgctcaagtctgacactcacgccctcctgccatcacgtggctcagactgagatgagctcatatacngcagtctatgacaaagcagactagttcggtggttcggacggacgggtaccaaggtccgtacggaacccgtccgtacgtacggtcacgaccccg

SEQ ID NO: 390590 - DNA, 523 bp, Homo sapiens
  misc_feature: GZ8MTXP02GZ1HL.9.19.B08.1.454.CMB.2.raw
  modified_base (437)..(437): a, c, t, g, unknown or other
  modified_base (446)..(446): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtctggggccccagggcagagggtcaccatctcctgcactggcagcagttccaacatcggggcaggttatgatgtccactggtaccagcagtttccaggacagcccccaggtcctcatctttggtacagtaatcggcctcgaccggggtccctgaccgattctctggctccaagtctgacacctcacgccctcctggccctatccacgtgggcctccagactgagatgagctgattatactgcctagttctatnaacaacgtnaacgtaactgtttcgggtgttacgggcgggaacggaccaaaggctacggacccgtcctcgacgtacgacgaaccccg

SEQ ID NO: 390591 - DNA, 542 bp, Homo sapiens
  misc_feature: GZ8MTXP02HEH6F.9.19.B08.1.454.CMB.2.raw
  modified_base (361)..(361): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccaggtcctcatctttggtacagtaatcggcctcacggggtccctgaccgattctctggctccaagtctgacncctcacgccctccctggcccatccactgggctccagcctgaggatgaaggctcattattactcgccagtcttatagacaaaacgtcaagaactagtttacgggtgttacgggacgggaacggggtacccaaaggtccgtacggtacccgttccgtacgtacgttaccgtacgaacccccgg

SEQ ID NO: 390592 - DNA, 494 bp, Homo sapiens
  misc_feature: GZ8MTXP02G7PJZ.9.19.B08.1.454.CMB.2.raw
  modified_base (416)..(416): a, c, t, g, unknown or other
  modified_base (426)..(426): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacacgcccccaggtcctcatctttggtacagtaatcgcctcgacggggtcctagaccgattctctggctccaagtctagacacctcacgcctccctgccatcactggctcagactgagatgagctacattactangccagtctangaacaaagtcagaactagttggtgttacggcgacggaccaagctcgaccgtctacacgtcacgacccg

SEQ ID NO: 390593 - DNA, 539 bp, Homo sapiens
  misc_feature: GZ8MTXP02JDS3N.9.19.B08.1.454.CMB.2.raw
  modified_base (250)..(250): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgcctcagtgtctggggccccagggcagaggtcaccatctcctgcactggcagcagttccaacatcggggcaggttangatgtccactggtaccagcagtttcaggaacacgccccaggtcctcattctttggtacagtaactcggccctcgaccggggtccctgaccgattctcgtggcctaccaagtctgaccactcacgccctcctggcccatcacgtcgggcctccgagactgaggatgaggcttcatttacttactcgtcccgtagttcttaacgtgaactaaacgtacaagtaactagtttgggtagttacgggcggtaacgggacccaaagcgtacgacccgtctcacggtcacgacccg

SEQ ID NO: 390594 - DNA, 558 bp, Homo sapiens
  misc_feature: GZ8MTXP02IZL34.9.19.B08.1.454.CMB.2.raw
  modified_base (254)..(254): a, c, t, g, unknown or other
  modified_base (462)..(462): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactacacagggtcctgggcccagtctgtgctgacgcagccgccctcagtgtcgtggggccccagggcagagggtcaccatctcctgcactggcagcagttccaacagtcggggcaggttangatgtccactggtaccagcagtttccaggacacgcccccgaggtcctcatctttaggtacagtaactccggccctgacgggtccccctgaccgtattcctctggtcctccaagtctgacctacctcacgtccctcccgtcgacctactccacgtcgggcctccgagactgacgatggagctactacgttatactcgactagtacttanagaacaaacgtcaagtactagtttgggtcgttacgggacgggtacggaaccaaggtccgtaacgtacccgtcctacgagtaccacgacccgaacgg

SEQ ID NO: 390595 - DNA, 560 bp, Homo sapiens
  misc_feature: GZ8MTXP02HV2JH.9.19.B08.1.454.CMB.2.raw
  modified_base (238)..(238): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtggggccccagggcagagggtcaccatctcctgcactggcagcagttccaanagtcggggcaggttatgatgtccactggtaccagctagtttccaggaacacgccccaggtcctcattctttggtacagtaatccggtcctcgacggggtccctggaccgtatttctctcggctaccaagtctcgacacctcacgccctcctggccatccacgttcggctacacgactagacggatggagtcttactattatactgaccagttcttatacgaactaaacgtacaagtaaacttagtttcggggtagtttacggacgggtaacgggaaccaagcgtacggtaacccgttcctacgacggttccaacggaccccg

SEQ ID NO: 390596 - DNA, 506 bp, Homo sapiens
  misc_feature: GZ8MTXP02GAF0A.9.19.B08.1.454.CMB.2.raw
  modified_base (256)..(256): a, c, t, g, unknown or other
  modified_base (414)..(414): a, c, t, g, unknown or other
  modified_base (420)..(420): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcagagggtcaccatctcctgcactggcagcagttccaacagtcggggcaggttangatgtccactggtaccagcagtttccaggaacacgccccaggtcctcatctttgtacagtaatcgcctcgacggggtcctgacgtattctctggcctccaagtctacgacacctcacgccctccctggccatcacgtggcctcagctgagatgagctnattatncgcagttctatgaacaaacgtcaagtaactagtttcggtgttcggacggacggacaagcgtacgaccgtctcgacgtcacgacccg

SEQ ID NO: 390597 - DNA, 767 bp, Homo sapiens
  misc_feature: GZ8MTXP02H19YJ.9.19.B08.1.454.CMB.2.raw
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtcgtggggccccagggcaggagggtcacatctcctgcactggcagcagttccaacagtcggggcaggtatgatgtccactggtaccagctagtttccaggaaccacgaccccccgaggtccctacgtattcgtttggttaacagtaaacgtccggccctcggacccggggtcccctacgaccggtactttcgtccgtcggtcctaccgtaaacgttcctacgaccctacccgtcaacccggtcccctcccgtacggcccctaacgttacccgtaaccgttcggggtacccttacccgaaacgggtaacccgttagggaaaaccgggtgtaccgggggtaaacggtcctttaaccggttaaacgtttaaacctttaaccgttaggtaaccccgtaaagggtttttaccttaaacgttaacggtaaaccgtaaaaccgggtaccctaaaagtaaaacccggttttagggtttacggggttacggggtttaccgggaaccgggggttaaacggggtaaccccgaaaggtaaccgtacggtaaaccccggttccctaacgtacccggttaccgaacccggaaccccgg

SEQ ID NO: 390598 - DNA, 536 bp, Homo sapiens
  misc_feature: GZ8MTXP02JSZPN.9.19.B08.1.454.CMB.2.raw
  modified_base (312)..(312): a, c, t, g, unknown or other
  modified_base (343)..(343): a, c, t, g, unknown or other
  modified_base (372)..(372): a, c, t, g, unknown or other
  modified_base (448)..(448): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgttctgacgcagccgccctcagtgtctggggccccagggcagagggtcaccatctcgtgcactggaagtagctaccaacgagtcggggcacgttatgatgtacactggtaccaacaacttccaaggaacacgacccccaaagtcatcatttanagacaacatgaacgcgccctgacgggtcccngaccgattctccgctccgaagtctggcanactcacgccctcccgtaggcctactccacgtcgggcctaccgaggcctagagtatggacggctagacttacttacngacctagtcgtatgacagtcgacctaagtacatcgtacttacggaactggaaccaaggtccaaccgtcgtaggccacgaccaaaccgg

SEQ ID NO: 390599 - DNA, 685 bp, Homo sapiens
  misc_feature: GZ8MTXP02HE1GM.9.19.B08.1.454.CMB.2.raw
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcaggaggtcaccatcctcctgcactggcagcagttccaacagtcggggactaggttatgatgtccacgtcggtaccagctagtttccaaggaaccacggcccccgagggtccctcatttcgtttggttaactacgtaaacgtccggtccctacgacccggggtccctgaccgtattcgtcgtcggcctccgtaagtcctacgtacctaccgtcaccgccctcccgtcggccctacgtccgaaccgtcgggacccttaccgaacgaccgttaggacggtagtcggacggtccttatagtttaacgttacctacgtaccgtagttacgttaagtaaccgtaaactaaaacgtaccgtaaagtaaaaccgttgggttttcggggtaacgggtttccgggaacggggtaaccggtaaacccgtaacggtaaccgttaaccggtacccgttacccgtacgtaaccggttccgaacccggtaacccccgg

SEQ ID NO: 390600 - DNA, 497 bp, Homo sapiens
  misc_feature: GZ8MTXP02FWJ3N.9.19.B08.1.454.CMB.2.raw
  modified_base (303)..(303): a, c, t, g, unknown or other
  modified_base (398)..(398): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcgggcaggttatgatgtccactggtaccagcagtttccaggaacagcccccaaagtcatcattangacaacatgaagccggccctcaggggtccctgaccgattctccggctcaagtctggcacatcagccctcctgccatcactgggctccagctgagntgaggctgactagtactgccagtcgtatcgacagtggacctaaaggtaacattcgtcttcggaacgtcgggaaccgaaggtccaccgtcctggggtacc

SEQ ID NO: 390601 - DNA, 678 bp, Homo sapiens
  misc_feature: GZ8MTXP02HGL9S.9.19.B08.1.454.CMB.2.raw
  modified_base (372)..(372): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcagagggtcaccatctcctgcactggcagcagttccaacagtcggggcaggttatgatcgtccacgtcggtaccagcctagtttaccaggaaccacgcccccgaggtccctcgtattcgtttcggtactacgtaacgtccggcccgtcgacccggggtccctgaacccgtnttccgtcgtcggtcctaccgtaaaggttcctacgaccctacccgtacgaccgtccccttcccgtcggtccctaacgtccaaccgttcggggccccttaccgaacgttaccgtaggaaggtacgttcggaacggtcttacgttaactttacgtttaaccgtccggtacccttagtttaccttagtacgtaaacctaaaacgtacgtaaacgtaaacgttaggtttaggggtacggttacgggacggggtaacggaacctaacggaaccgtccgtaaccgttccgacgtaccgtacgaccgtacccgg

SEQ ID NO: 390602 - DNA, 569 bp, Homo sapiens
  misc_feature: GZ8MTXP02GCPP9.9.19.B08.1.454.CMB.2.raw
  modified_base (252)..(252): a, c, t, g, unknown or other
  modified_base (368)..(368): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagaggtcaccatctcctgcactggcagcagttccaacagtcggggcaggttangatgtccactggtaccagcagtttccagacacgccccaggtcctcatcgtttgtacagtaactcggcctcgacgggtccctgaccgattctctgctccaagtctgactacctcacnccctccctgccatcacgtcggctacagactagacgatgaggtctactatttactactacgacctacgttacttacgtagaaacctaaacgtccgaaagtaacctaggtttcggggtacggtttaccgggacgggaacgggtaacccaaacggtcgttaccggaacccgttcccgtacgtacggtaccgaacgaacccccgg

SEQ ID NO: 390603 - DNA, 502 bp, Homo sapiens
  misc_feature: GZ8MTXP02JEIIT.9.19.B08.1.454.CMB.2.raw
  modified_base (403)..(403): a, c, t, g, unknown or other
  modified_base (412)..(412): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagaggtcaccatctctgcactggcagcagttccaacatcggggcaggttatgatgtccactggtaccagcagtttccaggaacacgcccccaggtcctcatctttggtacagtaatccggcctcgacggggtccctgaccgattctctgctcaagtctgacactcagcctccctgccatcactggctcagctgagatgaggctnattattacngccagtcttatcgaacaacgtcaacgactagtttcgggtgttcggcggtacggacccaagccgtacgaccgtctcgacgtcgacgacccg

SEQ ID NO: 390604 - DNA, 705 bp, Homo sapiens
  misc_feature: GZ8MTXP02HQF1W.9.19.B08.1.454.CMB.2.raw
  modified_base (257)..(257): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcaggagggtcaccatctcctgcactggcagcagttccaacagtcggggcaggttangatgtccagtggtaccagctagtttccaaggtaaccacgcccccgaggtcctactacgttccgttttaggtactaggttaaacgtccggtacccctcgaccccggggtccctcggaccgttacgtttctaccgttcggccttaaccgtaaacggttcttaccggaacctaccctcgtaacccgtcccttcccgtacggccctaaacgtcccgtaacgttacggggcccttaccgaacggttaccgtaggaacggtagtcggaaacggtctttacgtaactttaacgtttaccgtaccgtaccgtaacggtttacctttaagtaacgtaaacgtaaaacgttcccgaaaaggttaaaccgttaggttttcgggtacggttacgggacgggaacggtaaccgacgtccgtacggtaacccgttcgtacgacgttaccgacgtaaccccgg

SEQ ID NO: 390605 - DNA, 687 bp, Homo sapiens
  misc_feature: GZ8MTXP02JTP7H.9.19.B08.1.454.CMB.2.raw
  modified_base (178)..(178): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgcctnagtgtcgtcggggccccagggcagagggtcaccatctctgcactggcagctacgttccaacagtcggggcaggttatgatgtccactggtaccagctagtttaccaggaacaccgccccgaggtcctcgtactttcgtttaggtacagttaaacgtccggacccgtcgaccggggtccctggaccgtactttcgtcgttcggtcctaccgtaaacgtccgtacgacctacccgttacgaccgtccccttcccgcggtaccctacgtccgtaccgtcggggtcccttaccgaacggtaccgttagggaacggtacgttacggacgggtacttacgtaacgtttaacttacggtaccgtacccttagtttacccgttaagtaaccgtaaacgtaaaaccgtactaaacggtaaaccgttaggtttacgggggtacggtttacggggaccggggtaaacggaccgtaacggtccgtacggtaacccgtcgtacgacgtaccgacgaacccgg

SEQ ID NO: 390606 - DNA, 700 bp, Homo sapiens
  misc_feature: GZ8MTXP02GSX1C.9.19.B08.1.454.CMB.2.raw
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcacgcccgccctcagtgtcgtcggggccccagggcaggagggtcaccatctcctgcacgtggcagcacgttaccaacagtcggggctaggttatgatgtccacgtaggtaccagctagtttaccaggaaccaccggccccgtaagggtcctactactttcgttttaggtaactaggtaacgtccggaccccgttcggaccgggggttacccctagaacccggttcttccgtcgtcggggtcctaccgtaaacggttcctacgaccctacccttacgacccgtccctcccgtcggaccctaacgtccaacgttccgggacccttaccgaaggtaccgttggaacggtagtacggacggtctacgtaatttacttaacgtcgtaccgtagttacttaacacgtaaaccgtaaacgtactaaacggtaacgtttaacggggtttcgggtacgggttaccgggaacgggtaaaccggaacgtaacggtccgtacggtaacccgtcgtaccgtacggaaccgtaccgaaaccccggg

SEQ ID NO: 390607 - DNA, 562 bp, Homo sapiens
  misc_feature: GZ8MTXP02GUFZE.9.19.B08.1.454.CMB.2.raw
  modified_base (372)..(372): a, c, t, g, unknown or other
  modified_base (378)..(378): a, c, t, g, unknown or other
  modified_base (380)..(380): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtctggggccccagggcagaggtcaccatctcctgcactggcagcagttccaacagtcggggcaggttatgatgtccactggtaccagcagtttccaggaacacgccccaggtcctcatctttggtacagtaactcggccctcgacggggtccctgaccgtattctcttcggctccaacgtctcgaacncctccncncctcctcgcactctcgtcgctcgacgacgtagagagtgacgctactacttactactacgtacgtacgtacttacgtacgaacgtaaacgtacgtaacgtaacgttaggttacgggttacggtacgggtacggacggtaacgacgtaacgtacgtaccgtaccgtacgtacgtacgacgaccg

SEQ ID NO: 390608 - DNA, 783 bp, Homo sapiens
  misc_feature: GZ8MTXP02FN2U5.9.19.B08.1.454.CMB.2.raw
  modified_base (273)..(273): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtcgtcgtcggggccccagggcaggacgggtccaacctatcctcctgcacgtggcagctacgttcccaaacgtagtccggggactaggttanagactcgtacctacgtacggtaccagtactacgtttaccgaaggtaaccaccgtcccccgtaggtccctacgtacgtttcgtttacggtaactacgtaaccgtccggtccccgttcggtaccccggggttccctacgtaccgtacttcgtacgtcgtccgtactacgtctacgtacctaccgtcaccgtccctccgtccggacctaactccgtacgttccgggacctaccgaacgtcgtacggtaggtacgtacggtaacgtctacttaacgtttaaccgttaccgttccggtaaccttaacgttaccgttaaacgtaacggtaaaacccgttaaaacggtaacccgttaaaaggttaccggttttaaggggttttaccgggggttttaaacggggttacccggggtaaacggggaaacccgggggttaacgttaaacccggtccggtttacccggtaaacccccggttccgtaacccgttacggtaccccgtaaccggtaaacccccgg

SEQ ID NO: 390609 - DNA, 670 bp, Homo sapiens
  misc_feature: GZ8MTXP02FLKIR.9.19.B08.1.454.CMB.2.raw
  modified_base (253)..(253): a, c, t, g, unknown or other
  modified_base (287)..(287): a, c, t, g, unknown or other
  modified_base (384)..(384): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcacgccgccctcagtgtctcggggccccagggcagagggtcacatctctgcactggcagcagttccaacagtcggggcaggttangatgtccactggtaccagctagtttccaggaacncgccccaggtcctctattcgttaggtacagtaacgtcggaccgtcgaccggggtccctgacctagttcctcgtcgtctacctaaacgtctcgaaccnccttacaacgtccctcccgttaccggccctaactccgaacccgtcggggtccctacccgtaacggtaccgtacgggtaacgggaacgtttcgggaaacgggtccgttacttaaacgtttaaccggtttaacttccgtaccgtaacggtttacttagttaccgaaaacgtaaacgtaacgtaacgtaaacgttaagtttcgggggtacggtttacggggacgggtaacggggaccttaaacggccgtacggtaaccgtccgtaccgtacggtaccgacgaaccccgg

SEQ ID NO: 390610 - DNA, 531 bp, Homo sapiens
  misc_feature: GZ8MTXP02GH2VT.9.19.B08.1.454.CMB.2.raw
  modified_base (241)..(241): a, c, t, g, unknown or other
  modified_base (255)..(255): a, c, t, g, unknown or other
  modified_base (271)..(271): a, c, t, g, unknown or other
  modified_base (349)..(349): a, c, t, g, unknown or other
  modified_base (353)..(353): a, c, t, g, unknown or other
  modified_base (376)..(376): a, c, t, g, unknown or other
  modified_base (410)..(410): a, c, t, g, unknown or other
  modified_base (412)..(412): a, c, t, g, unknown or other
  modified_base (416)..(416): a, c, t, g, unknown or other
  modified_base (436)..(436): a, c, t, g, unknown or other
  modified_base (448)..(448): a, c, t, g, unknown or other
tcagtgatacgtctcacgaccggtgctcgatttagtgagtcagtaaggggcttcagctgtgggcacaagaggcagcactcaggacaatctccagcatgccctggtctcctctcctcctcactctcctcgctcactgcacagggtcctgggcccagtctgtgctgacgcagcccgccctcgagtgtccgtggggccccagggcaggagggtcaccatctcctgcactggcagcagttccaanatcggggcagttangatgtcactgtaccancagtttcagaacacgccccaggtcctacattctttggttacagtaaacgtcgcccttcgacggggtccctgaaccgtnttcntcgctacagtctgaccactcacnccgtccctggcccatcgacgtggcctccagaccngngtancgaaggctctattattaccncgactagtctanacgaactaagtacaacgtacgttggttcggtagtacgggacgacggtacacgtcgtacgtaccgtacacgacgtcgacgaccg

SEQ ID NO: 390611 - DNA, 894 bp, Homo sapiens
  misc_feature: GZ8MTXP02JJNKM.9.19.B08.1.454.CMB.2.raw
  modified_base (183)..(183): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcacgcccgccctacnggtcgtcgtccggggcccccgagggccaggacgggtccaaccgtatcctcctgactacgtggacagcctagttaccaacgacggtcggggctaaggttatagacgttcgtacctacgtcggtaacctacgtacgtaacggtttaccgaaacgggaaacccgaccccggtaccccccggtaacgggttacccctacgttacgttttaccgttttaacggttacctaaaggttaaccgttccccggtaccccgttcgggtacccccggggttacccctaccggtaccgttaaccgttttccggtccgttccggtacccgttacccgtaacggttacccgttaaccggaacccctaacccccttccgtaacccgggttcccccttcccccggttccggaaccccttaacgtcccggtaaccggtccggtaccccgtaccgaacccggttaacgacgggtaaggttacgtacggtaccggtaccttaaccgtttagtttaaccttacgtaccgtaccgttacggttactttaaacggaccgtaaaaccgtaaaacgggttactaaaaccggttacggtttacgggtttttaacggggtaccgggtttaaaccgggggaccggggttaaaaccggggaaccgtaaaccggggtccgtaaacccgggttaaccccggtcctacggttaaaccggcccggttaaacccgtaacccggg

SEQ ID NO: 390612 - DNA, 651 bp, Homo sapiens
  misc_feature: GZ8MTXP02JQ6Z9.9.19.B08.1.454.CMB.2.raw
  modified_base (178)..(178): a, c, t, g, unknown or other
  modified_base (265)..(265): a, c, t, g, unknown or other
  modified_base (371)..(371): a, c, t, g, unknown or other
  modified_base (443)..(443): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgcctnagtgtcgtcggggccccagggctaggagggtcaccgtatcctcctgcacgtggcagctagttaccaacacgtcggggcaggttatgntcgtccactggtaccagctacgttccaggtaacaccgccccgtaggtcctctacgtttcttggtaactagtaacgtccgcctcgtccgggtccagtaccgtattcncgtgtcctactacgtctagaccactcacgtccctaccgtcggccaagtcctacgtcgtccgacctacgtaancggacgtagtacggtacggtcccttaagtactttaacgttaacgtcgtacccggttattacgtttaacgtacgtaaaccgtaaaacgtaacgtaacgttaaaaccgttggggtttacggttacgggtacgggttacgggaaacgggaccgttaaacgggcgtaccggtaaccgttcgtcgtaacggttacccgaacggttaaccccgg

SEQ ID NO: 390613 - DNA, 654 bp, Homo sapiens
  misc_feature: GZ8MTXP02H74HG.9.19.B08.1.454.CMB.2.raw
  modified_base (300)..(300): a, c, t, g, unknown or other
  modified_base (398)..(398): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtcgtcggggccccagggcaggacgggtcaccatctctgcactggcagcagttccaacagtcggggacaggttatgatcgtaccacgtaggtaccagcctagtttaccacggaaacnccgcccccgaggtcctcactttcgttttaggtacagtaacgtcccggcctcgtaccggggtccctacgactacttctactcggcctacgaagtctacnccacctcacgccctacgcgacacgtcacgtcggacctccgagacgtaggaggtagtcgaacggtcttaacagtttactacgtccggtacttagttcttaacgtagaaacctaaaacgtcgaaaacgttaacggttaggttttacgggggtacgtttaccgggggaccggggtaaacgggtacccgtaaaacggttaaccgttacccggtaacccggttcccgttacgtaccggttaaccgtaccggtaaaccccgg

SEQ ID NO: 390614 - DNA, 736 bp, Homo sapiens
  misc_feature: GZ8MTXP02GRQU6.9.19.B08.1.454.CMB.2.raw
  modified_base (241)..(241): a, c, t, g, unknown or other
  modified_base (432)..(432): a, c, t, g, unknown or other
tcagtgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagcccgccctcagtgtctcggggccccagggcagagggtcaccatctcctgcactggcagcagttaccaacngtcggggcacggttatggatgtccactggtaccagctagtttccaaggaaccaccgacccccgtaagggtccctactacgtttcgtttacggtaacaacgttaaacgtccggaccccgttacgaccccggggtcccctacgtacccgtacttccgtccgtacgggtcctaccgaaacggtccttacgaccncccttcgaaccgtccctcccgttacggaccctactacctaacccgtcggggtacccttacccgaacgtaaccgtacgggaacggacgttacggaacgggtcccgttaccttaagtttaaacctttacgttacccggtacccttaaggtttacttaaacggttacaaaccgtaaaaccgtaactaacggtaaaacgtttaagggtttttcggggtacggtttacggggacccgggttaagggaaccgtaacggaaccggttacgacccccgttacgtacgaaccggtaccgaaccgtaaccccgg

SEQ ID NO: 390615 - DNA, 491 bp, Homo sapiens
  misc_feature: GZ8MTXP01BVNXK.51.29.C07.1.454.CMB.2.raw
  modified_base (487)..(491): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagtatttttcaaaacttataagtgtctacatcatattcttggagagatcactacgttaggaactgtggctgcaccatcgtgtcttcattccttcccgctatctgtatcgtagcaactcttggcgcgggctgggcagggcgcatgnnnnn

SEQ ID NO: 390616 - DNA, 488 bp, Homo sapiens
  misc_feature: GZ8MTXP01EMC4Q.51.29.C07.1.454.CMB.2.raw
  modified_base (227)..(227): a, c, t, g, unknown or other
  modified_base (396)..(396): a, c, t, g, unknown or other
  modified_base (426)..(426): a, c, t, g, unknown or other
  modified_base (477)..(477): a, c, t, g, unknown or other
  modified_base (483)..(488): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaancccctacgcgccttaactatgttacattcagtttgcaaagtggcgtcccatcaaggtccagcggcattggatcgtggggcagaattcactctcacatttcagcagctgcacgcctgaagtatttttcaaaacttataagtgtctacatcataattcttggagagatcanacgttggaactgtgctgcacatctgtcttnattcttcccgctatctgtatcgtagcaactcttgagcggctgggcagggcnagtaannnnnn

SEQ ID NO: 390617 - DNA, 483 bp, Homo sapiens
  misc_feature: GZ8MTXP01ANHO5.51.29.C07.1.454.CMB.2.raw
  modified_base (395)..(395): a, c, t, g, unknown or other
  modified_base (475)..(475): a, c, t, g, unknown or other
  modified_base (477)..(483): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcacgcctgaagtatttttcaaaacttataagtgtctacatcataattcttggagagatcanagttggaactgtggctgcacatctgtcttcatccttccgcatctgactcgtagcaactcttggagcgggctggcgagcgnannnnnnn

SEQ ID NO: 390618 - DNA, 497 bp, Homo sapiens
  misc_feature: GZ8MTXP01A8SGO.51.29.C07.1.454.CMB.2.raw
  modified_base (227)..(227): a, c, t, g, unknown or other
  modified_base (379)..(379): a, c, t, g, unknown or other
  modified_base (397)..(397): a, c, t, g, unknown or other
  modified_base (441)..(441): a, c, t, g, unknown or other
  modified_base (456)..(456): a, c, t, g, unknown or other
  modified_base (487)..(487): a, c, t, g, unknown or other
  modified_base (492)..(497): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcctttcagcagagaccagggaaacncccctacgcgccttaaactatgttacattcagttttgcaaagtggcgtcccatcaaggtccagcggcattggatcgtggggcagaattcactctcacattcagcagcctgcacgcctagaagtatttttacaaaactttataagtgtactanatcataattctggagtanatcacacgttgaactgtgctgcaccattctgtcttcactctccnccatctgtatcgtancaactcttgacgcgggtctggcagggcaacngtaannnnnn

SEQ ID NO: 390619 - DNA, 502 bp, Homo sapiens
  misc_feature: GZ8MTXP01A8Q1L.51.29.C07.1.454.CMB.2.raw
  modified_base (495)..(502): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatcgtggggcagaattcactctcacattcagcagcctgcacgcctagaagtatttttcaaaacttataagtgtactacatcataattcttggagagatcactacgttaggaacttgtggctgcacattctgttcttcattccttcccgctatcctgtactcgtacgctaactcgttgacgcgggctgggcagggcaannnnnnnn

SEQ ID NO: 390620 - DNA, 535 bp, Homo sapiens
  misc_feature: GZ8MTXP01DH1AM.51.29.C07.1.454.CMB.2.raw
  modified_base (374)..(374): a, c, t, g, unknown or other
  modified_base (525)..(525): a, c, t, g, unknown or other
  modified_base (528)..(528): a, c, t, g, unknown or other
  modified_base (530)..(535): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcctttcagcagagaccagggaaacgcccctacgcgaccttaactatgttacattcagtttgacaaagtggcgtcccatcaagtccagcgcattggatcgtggggcagaattcactctcactattcagcacgcctgcacgcctagaagttattttacaaaactttataacgtntactacatacaattattcgttagggagtagtatacacgtacgttaggaacttgtggctgccactattcgttagttcttacacttccctccccgctattccgtgtacttcgtacgtctaactcgttggacggcggtcgtgggacgaggccgngangnnnnnn

SEQ ID NO: 390621 - DNA, 526 bp, Homo sapiens
  misc_feature: GZ8MTXP01A8XUE.51.29.C07.1.454.CMB.2.raw
  modified_base (228)..(228): a, c, t, g, unknown or other
  modified_base (486)..(486): a, c, t, g, unknown or other
  modified_base (493)..(493): a, c, t, g, unknown or other
  modified_base (509)..(509): a, c, t, g, unknown or other
  modified_base (517)..(517): a, c, t, g, unknown or other
  modified_base (519)..(519): a, c, t, g, unknown or other
  modified_base (521)..(526): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaacncccctacgcgaccttaactatgttacattcagtttgcaaagtggcgtcccatcaaggtccagcggcagttggatcgtggggcagaattcactctcacattcagcagcctgcacgcctagaagtattttacaaactttataagtcgtactatatactaattattcgtagggagagtatcaacgtacgttaggaacttggtcggacttcgacactactcttgttccttcacttccttcccgctagtcctgtactcgtacnctctcgngcggcggtcgtggcgnggcgaacngngnnnnnn

SEQ ID NO: 390622 - DNA, 552 bp, Homo sapiens
  misc_feature: GZ8MTXP01B8I7F.51.29.C07.1.454.CMB.2.raw
  modified_base (301)..(301): a, c, t, g, unknown or other
  modified_base (305)..(305): a, c, t, g, unknown or other
  modified_base (364)..(364): a, c, t, g, unknown or other
  modified_base (370)..(370): a, c, t, g, unknown or other
  modified_base (547)..(552): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccaagggaaacgcccctacgcgccttaaactatgttacattcagtttgcaaagtggcgtccatcaagtccagcgcatggatcgngggnagatcactctcacatcagcagcctgcacgctagaagtacttttacaaactttataagtntactanatctatattcgttaggagagtactcacgtacgttaggaacgttgtcggtctgacctacctattcgttcgttcctttaccactttcccttccccgacctacttccgtagtacttaccgtacgcctaacgtcgttgggaacggttccgggtacgtcgggacaaggggccaagagtaagnnnnnn

SEQ ID NO: 390623 - DNA, 562 bp, Homo sapiens
  misc_feature: GZ8MTXP01BADAI.51.29.C07.1.454.CMB.2.raw
  modified_base (209)..(209): a, c, t, g, unknown or other
  modified_base (228)..(228): a, c, t, g, unknown or other
  modified_base (460)..(460): a, c, t, g, unknown or other
  modified_base (555)..(555): a, c, t, g, unknown or other
  modified_base (557)..(562): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtcctccaccctccctgtctgcttctgtacgagacagagtcaccatcacttgccggacaagtcagggcactagaagttcttaggctcctttnagcagagaccagggaaacncccctacgcgtaccttaactatgttacattcagtttgacaaagtcggcgtcccatcaaggtccagcgcattggatcgtggggcagtaattcactctcacattcagcacgcctgccacgtcctagtaaagttactttttacaaaactttaataagtcgtactaacattactaattaattcgtaggagagactacaacgtacggttaggaactggtcggactgacctaaccttnttcgttcgttcttctacttccctcccgctactcgtcgtacgtcgtacgtcctaacgtcgcggacgggttcggtcgtcgggacgacggcgaatagngnnnnnn

SEQ ID NO: 390624 - DNA, 547 bp, Homo sapiens
  misc_feature: GZ8MTXP01BFL10.51.29.C07.1.454.CMB.2.raw
  modified_base (210)..(210): a, c, t, g, unknown or other
  modified_base (229)..(229): a, c, t, g, unknown or other
  modified_base (324)..(324): a, c, t, g, unknown or other
  modified_base (541)..(544): a, c, t, g, unknown or other
  modified_base (546)..(547): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctcccaccctccctgtctgcttctgtacgagacagagtcaccatcacttgccggacaagtcagggcactagaagttctttaggctcctttnagcagagaccagggaaacncccctacgcgccttaactatgttacattcagtttgcaaagtggcgtcccatcaaggtcagcggcagttggatcgtggggcagaattcactctcanattcagcagcctgcacgcctagatattttcaaacttataagtgtactacatactattaattcttaggagagatacactaggttagactgtacggctcgacactattctcgttcttcacttccgttccccgctatcctgtacgttccgttacgcctaacgttcgttacgggacgggcggggtacgtacggggaccgaacgggccggaactagtaaggnnnngnn

SEQ ID NO: 390625 - DNA, 539 bp, Homo sapiens
  misc_feature: GZ8MTXP01EJ83M.51.29.C07.1.454.CMB.2.raw
  modified_base (227)..(227): a, c, t, g, unknown or other
  modified_base (349)..(349): a, c, t, g, unknown or other
  modified_base (403)..(403): a, c, t, g, unknown or other
  modified_base (483)..(483): a, c, t, g, unknown or other
  modified_base (527)..(527): a, c, t, g, unknown or other
  modified_base (534)..(539): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctccttcagcagagaccagggaaacnccctacgcgcttaactatgttacattcagtttgacaaagtggcgtcccatcaaggtcagcggcattggatcgtggggcagaattcactctcactattcagcacgctgctacgcctagaagtnttttaacaaactttataagtgtactacatactataattctaggagagatacganacgttagggaacttgggcgatgacactatcgttactttcttcacttccgttaccccgcttactcgtagtacttacgtacncctaacgttcgcggtacggcgggtagtcgggacgacggcgtaanagtaagnnnnnn

SEQ ID NO: 390626 - DNA, 717 bp, Homo sapiens
  misc_feature: GZ8MTXP01BTI6B.51.29.C07.1.454.CMB.2.raw
  modified_base (125)..(125): a, c, t, g, unknown or other
  modified_base (229)..(229): a, c, t, g, unknown or other
  modified_base (710)..(712): a, c, t, g, unknown or other
  modified_base (715)..(715): a, c, t, g, unknown or other
  modified_base (717)..(717): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtcctccnccctccctgtctgcttctgtacgagacagagtcaccatcacttgccggacaagtcagggcactagaagttcttaggctccttcagcagagaccgaagggaaacncccctacgccgtaccttaaactatgttaactattctagttttagacgtaaaggtcggtaccgtcccatacgaaggtcccaggcggctagttcggagtcgtggggacagtaattccactctacatactttcagtcacgtcctacgacgtaccgtccgtaggtaaactttactttttaaccaaaaaaccttttattaaggttcttaccttaaactacttaacctaaatttaaacgtttagttagggtaaggtaagtaacttactaaaccggttaacggtttagggtaaaccgttggtaacgggtcttcgggtaacctaaccttaacgttccgggtttcgtttaccctttaaccgtacccgttttccccgttaacccccgtacccttactttaccccgttaggtaccgtttaccggtacctaccgtaacgtccggttagggaccgggttccgggtcggttacgggaccgacgggacgcataagnnntgngn

SEQ ID NO: 390627 - DNA, 527 bp, Homo sapiens
  misc_feature: GZ8MTXP01BJQI6.51.29.C07.1.454.CMB.2.raw
  modified_base (228)..(228): a, c, t, g, unknown or other
  modified_base (264)..(264): a, c, t, g, unknown or other
  modified_base (276)..(276): a, c, t, g, unknown or other
  modified_base (290)..(290): a, c, t, g, unknown or other
  modified_base (293)..(293): a, c, t, g, unknown or other
  modified_base (518)..(518): a, c, t, g, unknown or other
  modified_base (522)..(527): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaacnccctacgccgaccttaactatgttacattcagttgnaagtgcgtccancagtcagcgcatgntgngggacagtattcactctcactattcagacacgcctgcacgcctagtaacgttatttttacaaaacgtttataagtgtactactatactaattattcgtaggagagatcacgtagttagacgtgtacggctcgacactattcgttcgttccttctacgttcctccccgctactcgtctagtcgtacgctaacgttcgttggacgttcgggctgggacagggcaatnaagnnnnnn

SEQ ID NO: 390628 - DNA, 554 bp, Homo sapiens
  misc_feature: GZ8MTXP01A6NA3.51.29.C07.1.454.CMB.2.raw
  modified_base (227)..(227): a, c, t, g, unknown or other
  modified_base (380)..(380): a, c, t, g, unknown or other
  modified_base (388)..(388): a, c, t, g, unknown or other
  modified_base (496)..(496): a, c, t, g, unknown or other
  modified_base (499)..(499): a, c, t, g, unknown or other
  modified_base (506)..(506): a, c, t, g, unknown or other
  modified_base (515)..(515): a, c, t, g, unknown or other
  modified_base (522)..(522): a, c, t, g, unknown or other
  modified_base (533)..(533): a, c, t, g, unknown or other
  modified_base (546)..(547): a, c, t, g, unknown or other
  modified_base (549)..(554): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcctttcagcagagaccagggaaacncccctacgcgccttaaactatgttactattcagtttgcaaagtggcgtcccatcaaggtccagcggcatggatcgtggggcagaattcaactctacactattcagtcagtcctgcacgcctagtaagttacttttactaaaacttataagttntccctaanatactaagttacgtttagtagggtaaggatactacgtaaccgtagggttaacgtaacgttggtcggctgtaccacgtacttcgggttcttcttactacttccctcccnctntaccttntatcgtacnctctcgnggcggcgcggngacggacgcgaanngnnnnnn

SEQ ID NO: 390629 - DNA, 510 bp, Homo sapiens
  misc_feature: GZ8MTXP02FR92V.51.29.C07.1.454.CMB.2.raw
  modified_base (228)..(228): a, c, t, g, unknown or other
  modified_base (444)..(444): a, c, t, g, unknown or other
  modified_base (460)..(460): a, c, t, g, unknown or other
  modified_base (506)..(510): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaacncccctacgcgccttaactatgttacattcagtttgcaaagtggcgtccatcaaggtccagcggcattggatcgtggggcagaattcactctcacattcagcagcctgcacgcctgaaagtatttttcaaactttatagtgtactacatcaattaattcttaggagagatcactacgttaggaactggtgctgcaccatctgtcttcatcctacccncatcctgactcgtacnctactcgtaggacggcgggctacggacgaaggcgaagacgtacgcnnnnn

SEQ ID NO: 390630 - DNA, 475 bp, Homo sapiens
  misc_feature: GZ8MTXP02FY51J.51.29.C07.1.454.CMB.2.raw
  modified_base (467)..(467): a, c, t, g, unknown or other
  modified_base (469)..(469): a, c, t, g, unknown or other
  modified_base (471)..(475): a, c, t, g, unknown or other
tcagcgatcgtatacacgaccggtgctcgatttagagtgctacgaagggaagggagctcctgggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttatagtgtctacatcataattcttggagagatcacacgttggaactgtgctgcaccatctgtcttcatcttcccgcatctgatcgtagcactctgacgcgggctggcaaggcaananannnnn

SEQ ID NO: 390631 - DNA, 483 bp, Homo sapiens
  misc_feature: GZ8MTXP02FKAP2.51.29.C07.1.454.CMB.2.raw
  modified_base (478)..(483): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagtatttttcaacttatagtgtctacatcataattcttggagagatcacacgttgaactgtggctgcacatctgtcttcatcttcccgcatctgatcgtagcactctgacgtcgggctcggacaagggcgcatagnnnnnn

SEQ ID NO: 390632 - DNA, 554 bp, Homo sapiens
  misc_feature: GZ8MTXP02J3H6N.51.29.C07.1.454.CMB.2.raw
  modified_base (226)..(226): a, c, t, g, unknown or other
  modified_base (363)..(363): a, c, t, g, unknown or other
  modified_base (380)..(380): a, c, t, g, unknown or other
  modified_base (455)..(455): a, c, t, g, unknown or other
  modified_base (550)..(554): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcttcagcagagaccaagggaaacncccctacgcgtaccttaaactatgttactattctagtttgacaaaggtcggccgtcccatcaaacggtccagcgctagttggatcgtggggacagacttcactctacactatcagcagcctgcacgacctgaacttnttttacaacttatagtntactacatactaatttattcgtagggaagatactacaacgtcgttagggtacctggttgacgttcactaccgttnttctcttcttctaccttccctccgactactcgtacgtacgtacgactctacgtcggacggcgggtcggcgtacggacgtacggcgaacgagagcnnnnn

SEQ ID NO: 390633 - DNA, 504 bp, Homo sapiens
  misc_feature: GZ8MTXP02I3C17.51.29.C07.1.454.CMB.2.raw
  modified_base (450)..(451): a, c, t, g, unknown or other
  modified_base (499)..(504): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaacgcccctacgcgcccttaaactatgttacattcagtttgcaaagtggcgtcccatcaaggtccagcggcattggatcgtggggcagattcactctcacattcagcagcctgcagcctgaagtatttttacaactttatagtgtctacatcaattaattcttagggagagatcacgtacgttaggactgtgctgcacatctgttcttcatccttcccgctatctnntcgtagctactctggacggcgggcgtcggacgaacgggcgcgagtagnnnnnn

SEQ ID NO: 390634 - DNA, 520 bp, Homo sapiens
  misc_feature: GZ8MTXP02JPYW6.51.29.C07.1.454.CMB.2.raw
  modified_base (459)..(459): a, c, t, g, unknown or other
  modified_base (515)..(520): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcctttcagcagagaccagggaaagccctacgcgccttaactatgttacattcagtttgcaaagtggcgtcccatcaaggtccagcggcattggatcgtgggcagaatcactctcacattcagcagcctgcagcctagaagtattttcaacttatagtgtactactatcaataaattctaggtagagtatcaactacgttaggaactgtggtactgacaccattcctgtctttacacttccttcccgcctaattcctntaacgtcgtaagcctactccgtgacggcggctggaccgaagggccaacgtaagagnnnnnn

SEQ ID NO: 390635 - DNA, 537 bp, Homo sapiens
  misc_feature: GZ8MTXP02JS5NH.51.29.C07.1.454.CMB.2.raw
  modified_base (124)..(124): a, c, t, g, unknown or other
  modified_base (353)..(353): a, c, t, g, unknown or other
  modified_base (533)..(537): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccnccctccctgtctgcttctgtacgagacagagtcaccatcacttgccggacaagtcagggcactagaagttcttaggctcctttcagcagagaccagggaaacgcccctacgcgtaccttaactatgttaacattcagtttgcaaagtggcgtcccatcaaggtccaggcggcagttggatcgtggggcagtatcactctcactattcagcagcctgcacgctgaaattnttttacaaacttatagtgtactactatactaattaacttcgtaggaggtatatcaactacgttaggactggtcgctcgacacctattctgttccttcacttccctcccgactattccgtgtacttcgtacgcctactcgtcggacgggtcggacgtacggcgaacggcgtaacgatagcnnnnn

SEQ ID NO: 390636 - DNA, 565 bp, Homo sapiens
  misc_feature: GZ8MTXP02GNSSJ.51.29.C07.1.454.CMB.2.raw
  modified_base (315)..(315): a, c, t, g, unknown or other
  modified_base (320)..(320): a, c, t, g, unknown or other
  modified_base (366)..(366): a, c, t, g, unknown or other
  modified_base (557)..(557): a, c, t, g, unknown or other
  modified_base (559)..(559): a, c, t, g, unknown or other
  modified_base (561)..(561): a, c, t, g, unknown or other
  modified_base (563)..(564): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctccttcagcagagaccagggaaacgcccctacgcgaccttaactatgttacattcagtttgcaaagtggcgtcccatcaaggtccagcgcagttgatcgtgggcagatcactntcacnttcgagcagcctgcacgcctagaattacttttacaaacttatagtntactactatacaattaattcgttaggagagtatacaacgtacgttaggaactgtacggcttgacctactatcgtacgttcttcacttcccttcccgactacttctaggtacttccggacgtacctacgttaccgaggtacggtccggggacgttaccggggacgtacgggacccggaacgtaaagttcggngncngnng

SEQ ID NO: 390637 - DNA, 560 bp, Homo sapiens
  misc_feature: GZ8MTXP02IW28R.51.29.C07.1.454.CMB.2.raw
  modified_base (229)..(229): a, c, t, g, unknown or other
  modified_base (394)..(394): a, c, t, g, unknown or other
  modified_base (496)..(496): a, c, t, g, unknown or other
  modified_base (509)..(509): a, c, t, g, unknown or other
  modified_base (516)..(516): a, c, t, g, unknown or other
  modified_base (554)..(555): a, c, t, g, unknown or other
  modified_base (557)..(557): a, c, t, g, unknown or other
  modified_base (559)..(560): a, c, t, g, unknown or other
tcagcgatcgtatacacgaccggtgctcgatttagagtgctacgaaggggaaaggggagctcctggggctcctgctgctctggttcccaggtcccaggtgtgacatccagatgacccagtcctccaccctccctgtctgcttctgtacgagacagagtcaccatcacttgccggacaagtcagggcactagaagttcttaggctcctttcagcagagaccgagggaacncccctacgcgtaccttaactattgttacattctagtttgactaaaggtggccgtacccatacgaacggtccagcggcagttggatcgtgggacagtacttcactctcactattcagcagtcctgcacgtcctagtaacgttacttttacaaactttagtacgttntactactatacgtaattagttcgtagggaagtatactacgtaacgtagttgaacgttggtcgtctacgacacgtattctacgttctactctccttccgactntctgtactcgtanctacgtncggacggcggtactcggactaagggcctcgaagtcgcnncncnn

SEQ ID NO: 390638 - DNA, 597 bp, Homo sapiens
  misc_feature: GZ8MTXP02F7RR3.51.29.C07.1.454.CMB.2.raw
  modified_base (228)..(228): a, c, t, g, unknown or other
  modified_base (361)..(361): a, c, t, g, unknown or other
  modified_base (589)..(589): a, c, t, g, unknown or other
  modified_base (593)..(593): a, c, t, g, unknown or other
  modified_base (595)..(595): a, c, t, g, unknown or other
  modified_base (597)..(597): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaacncccctacgcgccttaactatgttacattcagtttgacaagtgcgtccatcaaggtcagcgcatggatcgtgggcagatcactctcacatcagcagcctgcacgctagtaagtacttttacaacttatacggtntactactactctaagtaacttcgttagggaggtaaagtactacgtaacgtacggttacgacgttcggtacggtactacgacctaccgtattaccgttacgttaccttaccgtaccgttaccccgttaccccgtaccttaacgttccgtagtaccgtaccgtacgtacctaccgtcgtagggaccgggtccggacgtacgggacgaacggacgtaacgtacgtacgacncacncncn

SEQ ID NO: 390639 - DNA, 537 bp, Homo sapiens
  misc_feature: GZ8MTXP02FQM2P.51.29.C07.1.454.CMB.2.raw
  modified_base (363)..(363): a, c, t, g, unknown or other
  modified_base (369)..(369): a, c, t, g, unknown or other
  modified_base (532)..(533): a, c, t, g, unknown or other
  modified_base (535)..(537): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtctgcttctgtacgagacagagtcaccatcacttgccggacaagtcagggcactagaagttcttaggctcctttcagcagagaccagggaaacgcccctacgcgccttaactatgttacattcagtttgcaagtgcgtccatcagtcagcgcatgatcgtggggcagattcactctcactattcagcacgcctcgcacgcctagaagttacttttacaaacttatacgtntactanatctaattattcttaggaggtagatactaacgtacgttaggaacgttcggtaggctcgcaaccgtatcttacgttcttctacttcccttacccgctatcgttagtctcgtacgctactactggcggtcgggtacgtcgggacgaacgggcgaacgtataggcnngnnn

SEQ ID NO: 390640 - DNA, 554 bp, Homo sapiens
  misc_feature: GZ8MTXP02IT4V4.51.29.C07.1.454.CMB.2.raw
  modified_base (315)..(315): a, c, t, g, unknown or other
  modified_base (480)..(480): a, c, t, g, unknown or other
  modified_base (491)..(491): a, c, t, g, unknown or other
  modified_base (512)..(512): a, c, t, g, unknown or other
  modified_base (549)..(550): a, c, t, g, unknown or other
  modified_base (552)..(554): a, c, t, g, unknown or other
tcagcgatcgtatacacgaccggtgctcgatttagagtgctacgaagggaaaggggagctcctggggctcctgctgctctggttcccaggtcccaggtgtgacatccagatgacccagtctccaccctccctgtcctgcttctgtacgagacagagtcaccatcacttgccggacaagtcagggcactagaagttctttaggctcctttcagcagagaccagggaaacgcccctacgcgccttaactatcgttacattcagtttgcaaagtggcgtcccatcaaaggtccagcggcattggatcgtgcggggganattcactctcactatttcagccagcctgccacgcctgaacgtatttttacaaactttatagttgtctactatctattaattcttagggtacgagtatcacgttagttaggaaccttggtacggcgttacgctaccagttctatttccttactcttccttaccccnctattccggtntacgtcgtactcctacgtcgnggcggcgggtcgtacggacgacggtcaagacgtagcnncnnn

SEQ ID NO: 390641 - DNA, 346 bp, Homo sapiens
  misc_feature: GZ8MTXP02G32YN.13.17.B06.1.454.CMB.2.raw
  modified_base (197)..(197): a, c, t, g, unknown or other
  modified_base (345)..(346): a, c, t, g, unknown or other
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtnaccgtctcctcagcctccaccaagggcccatcggtcttcccctggcgccctgctccaggagcacctccgagagcacagcggccctgggctgcctggtcaaggactacttcctagtacgtgactgagcgggctggcaaggcgccatagnn

SEQ ID NO: 390642 - DNA, 374 bp, Homo sapiens
  misc_feature: GZ8MTXP02FTZP1.13.17.B06.1.454.CMB.2.raw
  modified_base (250)..(250): a, c, t, g, unknown or other
  modified_base (366)..(366): a, c, t, g, unknown or other
  modified_base (371)..(374): a, c, t, g, unknown or other
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgagaggtgtacgtggggccagggacgccccggtcaccgtctcctcagcctccaccaagggcccagtccggtccttccccctggccnccctgcctcccgaggacgcccaccgtccgagacgcacacgccggtccctggggcctgccctggtaccaaaggtcctactcccgtagtacgtgactggacgcgggctaggcaaggcncatgnnnn

SEQ ID NO: 390643 - DNA, 417 bp, Homo sapiens
  misc_feature: GZ8MTXP01C8AOH.13.24.C02.1.454.CMB.2.raw
  modified_base (413)..(417): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatactttgactactggggccagggaaccctggtcaccgtctcctcagcctcaccaagggcccatcggtcttccccctggcaccctcctccaagagcacctctgggggcacagcggccctgggctgccttgtcaaggctacttcctaagtacgtgactgagcgggctggcaaggcgcatagnnnnn

SEQ ID NO: 390644 - DNA, 415 bp, Homo sapiens
  misc_feature: GZ8MTXP01CUQMI.13.24.C02.1.454.CMB.2.raw
  modified_base (407)..(407): a, c, t, g, unknown or other
  modified_base (409)..(409): a, c, t, g, unknown or other
  modified_base (411)..(415): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaaatgaacagcctgagagccgaggacacggccgtatattactgtgcgaaaggaaatttacccctatacttttgactacgtggggccagggaaccctggtcacgtctctcagcctcaccaaggcccatcgtctcccctggcacccctcctccaagagcacctctgggggcacagcggccctggctgcctggtcaaggactactcctaagtacgtgactgagcgggctggcaaggcgananannnnn

SEQ ID NO: 390645 - DNA, 533 bp, Homo sapiens
  misc_feature: GZ8MTXP01ASTXV.13.24.C02.1.454.CMB.2.raw
  modified_base (505)..(505): a, c, t, g, unknown or other
  modified_base (507)..(518): a, c, t, g, unknown or other
  modified_base (520)..(533): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactacgtggggccagggaccctggtcaccgtctcctcagcctccaccaagggcccagtccgtccttccccctggccacccctcctccaagacgccacctcgtcggggggcacgacggccgggcccgtggggcctcggccgttcgggtaccgaaacgggtaccttaacccgttcccgttaaacggttaaccgggtcggtaacgttcgggaacggggtcccgggggtccgttacgggggaccgaaacggggcccgacgaagtaggngnnnnnnnnnnnngnnnnnnnnnnnnnn

SEQ ID NO: 390646 - DNA, 411 bp, Homo sapiens
  misc_feature: GZ8MTXP01AFHAJ.13.24.C02.1.454.CMB.2.raw
  modified_base (313)..(313): a, c, t, g, unknown or other
  modified_base (316)..(316): a, c, t, g, unknown or other
  modified_base (386)..(386): a, c, t, g, unknown or other
  modified_base (403)..(411): a, c, t, g, unknown or other
tcagtcacgtactacacgaccggtgctcgatttagtacagatcgttagggaaagggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaagtaaatttacccctatacttttgactactggggccagggaaccctggtcaccgtctcctcagcctcacaggcccatcgtctcccctgcacctccncangcactctggggcacagccggcctgggctgcctggtcaaggactacttcctaagtacgtgactgagcgggntgggcaaggcgcatagnnnnnnnnn

SEQ ID NO: 390647 - DNA, 469 bp, Homo sapiens
  misc_feature: GZ8MTXP01D842O.13.24.C02.1.454.CMB.2.raw
  modified_base (461)..(469): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgacgaaggtaaactttacccctattacttttgactacgtggggccagggaaccctggtccaccgtctcctcacgccctccaaccgaacgggcccatccggtcccttcccccgcggccacccctcctaccaagcgccaccgtcgcgggggcaccgacggccggcccgtgggcctcgccgttacggtacaaggaccttacttccgtaaagtacgtgactgacggcgggctggggacaaggcgacagtagnnnnnnnnn

SEQ ID NO: 390648 - DNA, 484 bp, Homo sapiens
  misc_feature: GZ8MTXP01DWQAS.13.24.C02.1.454.CMB.2.raw
  modified_base (469)..(484): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggtaaatttacccctatacttttgactatggggccagggaaccctggtcaccgtctcctcagcctccaccaacgggcccagtccgtccttccccctcggccacccctcctccaagacgccacctcgtgggggccacgaggccggaccgtcggggctcgccgttcggtaccaaagggtaccttaccttcccgtaaacgttacgtggacttgggacgggccggggctcggggacgaaagggccgacgataggnnnnnnnnnnnnnnnn

SEQ ID NO: 390649 - DNA, 541 bp, Homo sapiens
  misc_feature: GZ8MTXP01BJTTS.13.24.C02.1.454.CMB.2.raw
  modified_base (517)..(541): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgacgaaggtaaatttacccctattacttttgactacgtggggccagggaaccctggtcaccgtctcctcacgcctccaccgaagggccccagtccggtccttccccccgtggccacccctccctccaagcgccacctcgtggggggcacgacggccgggccccgtggggtcctcggcccgttacgggtaccgaaacgggtacccttacctttacccgtaaacggttacccggtggaaccgttcggggaacgggtccccgggggtcgttacgggggaccgaaacgggggccgaccgaagttaggnnnnnnnnnnnnnnnnnnnnnnnnn

SEQ ID NO: 390650 - DNA, 410 bp, Homo sapiens
  misc_feature: GZ8MTXP01DP4U4.13.24.C02.1.454.CMB.2.raw
  modified_base (310)..(310): a, c, t, g, unknown or other
  modified_base (321)..(321): a, c, t, g, unknown or other
  modified_base (398)..(398): a, c, t, g, unknown or other
  modified_base (403)..(410): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccacacggcccatcgtctcccctggcnccctctccaangcactctgggggcacagcgcctgggctgccttgcctaaggctacttcctaagtacgtgactgagtcggctgcagcgnatagnnnnnnnn

SEQ ID NO: 390651 - DNA, 410 bp, Homo sapiens
  misc_feature: GZ8MTXP02HYG95.13.24.C02.1.454.CMB.2.raw
  modified_base (406)..(406): a, c, t, g, unknown or other
  modified_base (408)..(410): a, c, t, g, unknown or other
tcagtcacgtactacacgaccggtgctcgatttagtacagatcgttagggaagggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactgggccagggaaccctggtcaccgtctcctcagcctccaccaaagggcccatcggtcttccccctggccaccctcctccaagagcacctctggggcacagcgccctgggctgccttgtcaaagctactcctagtacgtgactgagcgggctgcagacgcaanannn

SEQ ID NO: 390652 - DNA, 415 bp, Homo sapiens
  misc_feature: GZ8MTXP02G4KVF.13.24.C02.1.454.CMB.2.raw
  modified_base (412)..(415): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaccctggtcaccgtctcctcagcctccaccaagggcccatcggtcttccccctggcaccctcctccaagagcacctctgggggcacagcggccctgggctgcctgtcaaggctacttcctagtacgtgactgagcgggctggcaaggcgcatagnnnn

SEQ ID NO: 390653 - DNA, 412 bp, Homo sapiens
  misc_feature: GZ8MTXP02G2EZU.13.24.C02.1.454.CMB.2.raw
  modified_base (408)..(412): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctggggcacagcgccctgggctgcctgtcaggactactctagtacgtgactgagcggctggcaaggcgcatagnnnnn

SEQ ID NO: 390654 - DNA, 419 bp, Homo sapiens
  misc_feature: GZ8MTXP02HNIYA.13.24.C02.1.454.CMB.2.raw
  modified_base (415)..(419): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagacgcacctctgggggcacagcggccctgggctgccttgtcaaggctacttcctagtacgtgactgagcgggctggcaaggcgcatagnnnnn

SEQ ID NO: 390655 - DNA, 424 bp, Homo sapiens
  misc_feature: GZ8MTXP02JRVS8.13.24.C02.1.454.CMB.2.raw
  modified_base (417)..(424): a, c, t, g, unknown or other
tcagtcacgtactacacgaccggtgctcgatttagtacagatcgttagggaaagggctggagtgggtctcaactattagtgctagtggtgccaccacatactacgcagactccgtgaagggccgattcaccatctccagagacaattccaagaacacgctgtatctgcaaatgaacagcctgagagccgagacacggccgtatattactgtgcgaaggaaatttaccccatacttttgactactgggccagggaccctggtcaccgtctctcagcctccaccaagggcccatcggtcttccccctggccaccctcctccaagagcacctctggggcacagcggccctggggctgccctgggtcaagggactacttcctagtaccgtgacctgagcgggctgggcaagggcgcatagnnnnnnnn

SEQ ID NO: 390656 - DNA, 403 bp, Homo sapiens
  misc_feature: GZ8MTXP02IVKVJ.13.24.C02.1.454.CMB.2.raw
  modified_base (315)..(315): a, c, t, g, unknown or other
  modified_base (395)..(395): a, c, t, g, unknown or other
  modified_base (399)..(399): a, c, t, g, unknown or other
  modified_base (401)..(403): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttaccctatacttttgactactgggccagggaaccctggtcacgtctctcagcctccaccaaggcccatcggtctcccctgccaccctccnccaagagcacctctggggcacagcggccctgggctgcctggtcaaggactactctagtacgtgactgagcggctgcaagngcanannn

SEQ ID NO: 390657 - DNA, 474 bp, Homo sapiens
  misc_feature: GZ8MTXP02IM3UZ.13.24.C02.1.454.CMB.2.raw
  modified_base (313)..(313): a, c, t, g, unknown or other
  modified_base (457)..(474): a, c, t, g, unknown or other
tcagtcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacgggccgtatattactgtgacgaaaggtaaatttaccccctattacttttgactacgtgggccagggaaccctggtcaccgtctctcagcctccaccaggccatcggtccttccccncggccacccctcctcaagacgcaccctcgtggggcacgacggccggcccgtggggcctcgtccgttgtaccgaaacgtaccttaccgttccgttaacgtacgtcgtaccgtgacgggcgggcgtaggcaagggtcgacagtcgnnnnnnnnnnnnnnnnnn

SEQ ID NO: 390658 - DNA, 515 bp, Homo sapiens
  misc_feature: GZ8MTXP01D5E5C.13.34.D01.1.454.CMB.2.raw
  modified_base (306)..(306): a, c, t, g, unknown or other
tcagtcacgtactacacgaccggtgctcgatttagatcgtctgtgttgggtttgggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctcctcatttanggtgcatccatagggccactggtcgtcccagtcaggttcaagcgcagtgggtctgggacagacttcactctcaccatcagcagcctgcagtctagagattttgctagtctattactgtcagcagtatagttactggagaaccttcggaccgtaaaggggacacgcttagggaagtaagttaaaggaacgtggttagggtccttggaacc

SEQ ID NO: 390659 - DNA, 503 bp, Homo sapiens
  misc_feature: GZ8MTXP01DYZ9C.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctctcatttatggtgcatccactagggccactggtctcccagtcaggttcaagcggcagtgggtctgggacaggacttcactctcacatcagcagcctgcagtctagagtattttgctagtctattactgtcagctagtatgttactggagttacttcggacgaagggacacgcttggaagaagttaaaggactgttggtcttggaac

SEQ ID NO: 390660 - DNA, 495 bp, Homo sapiens
  misc_feature: GZ8MTXP01DQJD9.13.34.D01.1.454.CMB.2.raw
  modified_base (223)..(223): a, c, t, g, unknown or other
  modified_base (306)..(306): a, c, t, g, unknown or other
  modified_base (310)..(310): a, c, t, g, unknown or other
  modified_base (447)..(447): a, c, t, g, unknown or other
  modified_base (485)..(485): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctntcctgcagggccagtcagagtgttagcagcagcttagcctggaccagcagaagcctggccaggctcccaggctcctcatttanggtncatccactagggccactggtctcccagtcaggttcaagcggcagtgggtctggggacagacttcactctcacatcagcagcctgcagtctgaagtattttgctagtctattactgtcagtctagtatagtactgganacttcgaccgtaaggcacgcttggaagataaggactgnggcttgaacc

SEQ ID NO: 390661 - DNA, 517 bp, Homo sapiens
  misc_feature: GZ8MTXP01CB9EW.13.34.D01.1.454.CMB.2.raw
  modified_base (305)..(305): a, c, t, g, unknown or other
  modified_base (354)..(354): a, c, t, g, unknown or other
  modified_base (427)..(427): a, c, t, g, unknown or other
tcagtcacgtactacacgaccggtgctcgatttagatcgtctgtgttgggtttggggagagctctggggaggaactgctcagttaggacccagacgaaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagcttagcctggaccagcagagcctggccaggctcccaggcctctcatttanggtgcatccagtagggccacgtggtcgtcccagtcaggttcaaggcggnaggtgggtctggggacagacttcactctcacatcagcagcctgcagtctagaagtatttgctagtctattacngtcagctagtatagttactggaacgaccttcgggcaaaggggcaccggagttaggaagtaagtttaaaggactggttaggccgttgaacc

SEQ ID NO: 390662 - DNA, 523 bp, Homo sapiens
  misc_feature: GZ8MTXP01AJT2N.13.34.D01.1.454.CMB.2.raw
  modified_base (310)..(310): a, c, t, g, unknown or other
  modified_base (314)..(314): a, c, t, g, unknown or other
  modified_base (357)..(357): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggcctccccaggcctcctcatttanggtncatccactagggccacgtggtctcccagtcaggttcaagcggnaggtgggtctgggacagacttcactctcacatcagcagcctgcagtctgaagtagtttgctagtctattactgtcagctagtatagttactgggacgttaccgttcggaccgaagggacacggcttagggaagtaagttaaaggaactggttaggtcgttcgaacc

SEQ ID NO: 390663 - DNA, 526 bp, Homo sapiens
  misc_feature: GZ8MTXP01CS7DH.13.34.D01.1.454.CMB.2.raw
  modified_base (291)..(291): a, c, t, g, unknown or other
  modified_base (350)..(350): a, c, t, g, unknown or other
  modified_base (433)..(433): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactccncatcaaatagtaacaacaatcggcccgcgaggggtccctcgaccgattctctggctcgnggtctggcactcacgcctccctggtcatcacgtcggctcgagctgagagtgagctggtattagttctgccagtcctatcgacngcagccgtgagttgtcgttcggtacgttcggggaccggggggttccaggtccgtcggtaacccgtcgtacggttcgtaacgcccgtaaccggg

SEQ ID NO: 390664 - DNA, 545 bp, Homo sapiens
  misc_feature: GZ8MTXP01D5N01.13.34.D01.1.454.CMB.2.raw
  modified_base (310)..(310): a, c, t, g, unknown or other
tcagtcacgtactacacgaccggtgctcgatttagatcgtctgtgttgggtttgtggagagctctggggaggaactgctcagttaggacccagacggaaccatggaagccccagcgcagcttctcttcctcctgctactctggctcccagatactactggagaaatagtgctgacgcagtctccagtccaccctgtctgtgtctccgagggaaatagcaaccctctcctgcagggccagtcagagtgtagcagcagcttagcctggtaccagcaagaagcctggccaggcctcccaggctcctcatttanggtgcactccacgtaggccacgtcggtctccagtcaggttccaggcggctaggtgggtctggggacagtacttcactctcacatcagcagcctgcagtctagaagttactttgctagtctattactgtactagctagtatagttaactggaacgtaacccgttcggaacccgaaagggaccgacggttacgtaagggaaagtaagttaaaacgggattagggttaaggcgtaacg

SEQ ID NO: 390665 - DNA, 509 bp, Homo sapiens
  misc_feature: GZ8MTXP01BNY97.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagctagcctggaccagcagaagcctggccaggctccccaggcctcctcatttatggtgcatccacgtagggccacgtggtctcccagtcaggttcaagcgcaggtgggtctggggacagacttcactctcaccatcagcagcctgcagtctgaagatttgctagtctatactgtcagctagtatagtctggagacttcggacgaaaggggcttaacgcttagggaatacgtaaaggactagttggaacgttgaacc

SEQ ID NO: 390666 - DNA, 513 bp, Homo sapiens
  misc_feature: GZ8MTXP01CP53M.13.34.D01.1.454.CMB.2.raw
  modified_base (306)..(306): a, c, t, g, unknown or other
  modified_base (310)..(310): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaaggggaaatagcaacctctcctgcagggccagtcagagtgtagcagcagctagcctggaccagcagaagcctggccaggcctccaggctcctctatttanggtncatccacgtaggccagtggtccgccccagtcaggtcaagcgcaggtgggctagggacagacttcactctcacatcagcacgcctgcagtctagaatgtttgctagtctattactgtcagtcagttatagtactaaggtacaccgttcgaccgaaagggacacgacgttagggaataagtaaaggaactggttcggcttgaacc

SEQ ID NO: 390667 - DNA, 562 bp, Homo sapiens
  misc_feature: GZ8MTXP01CYXST.13.34.D01.1.454.CMB.2.raw
  modified_base (224)..(224): a, c, t, g, unknown or other
  modified_base (292)..(292): a, c, t, g, unknown or other
  modified_base (298)..(298): a, c, t, g, unknown or other
  modified_base (302)..(302): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctntcctgcagggccagtcagagtgttagcagcagcttagctggacagcagaagctgccagctccagctcncattanggtncactccacgtacgggcctacgtggtcgtcccagtcgtaggttcaacggcggcgaggtgggtcgtggggacagtacttcactctacacatcagcacgctgctagtctagtaagttattttcgactagttacttaatttacgtcgtacaggacttaagttaagttagtttaacgtaacgggtaacgttaaaccgttcgggaccgaaaggggaccacggacgttagggaagtaaagttaaagggaactggttaggcttgaacc

SEQ ID NO: 390668 - DNA, 507 bp, Homo sapiens
  misc_feature: GZ8MTXP01CBYLP.13.34.D01.1.454.CMB.2.raw
  modified_base (306)..(306): a, c, t, g, unknown or other
  modified_base (365)..(365): a, c, t, g, unknown or other
  modified_base (421)..(421): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgtagcagcagcttagcctggaccagcagaagcctggccaggctccccaggctcctcatttanggtgcatccactagggccactggtctcccagtcaggtcaagcgcagtgggtctgggacngacttcactctcaccatcagcagcctgcagtctgaagtattttgcagtctattacngtcagctagtatagttactggagttaccttcggacctaaagggcttacgacttggaagaagttaaggactggttaggtcttgaacc

SEQ ID NO: 390669 - DNA, 528 bp, Homo sapiens
  misc_feature: GZ8MTXP01DXDG0.13.34.D01.1.454.CMB.2.raw
  modified_base (311)..(311): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaatagcaaccctctcctgcagggccagtcagagtgttagcagcagcttagcctggaccagcagaagcctggccaggctcccaggcctcctctatttatggtncatccatacgggccatcggtctcccagtcaggttcaaggcgcgagtgggtctggggacagacttcactctcacatcagcagcctgcagtctagaagtattttgctagtctagttactgttcagctagtatagttacgtgggtaacgttaaccgttcggaccgaaagggacacgacgttaggaagtaagttaaaggaactggttggtcgttcggaacc

SEQ ID NO: 390670 - DNA, 539 bp, Homo sapiens
  misc_feature: GZ8MTXP01BS6UM.13.34.D01.1.454.CMB.2.raw
  modified_base (406)..(406): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctcctctatttatggtgctatccgacgtacgggccacgtggtccgtcccagtcaggtcaagcggcagggtgggtcgtgggacagtacttcactctcacatcagcagctgcngtctagtaacgtgtttgactagttacttattactgtcagtctagttataggttacaaggtacttaacgttcggacgaacgggtacacgttacgttaggtaagtagttaaaggacgtggttacgtcgttgaacc

SEQ ID NO: 390671 - DNA, 538 bp, Homo sapiens
  misc_feature: GZ8MTXP01DUJ7F.13.34.D01.1.454.CMB.2.raw
  modified_base (357)..(357): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagcttagcctggaccagcagaagcctggccaggcctcccaggctcctcatttatggtgcatccacgtacgggccactggtccgtcccagtcaggttcaagcggngagtggggtctggggacagacttcactctcaccatcagcagcctgcagtctagtaagtattttgctagtacttattactgtcgagtctagtatagttacgtaaggtaacgaaccgttcggaccgaaacgggacacgacgttaggaagtaagttaaacggaacgtaggttagtcgttgaacc

SEQ ID NO: 390672 - DNA, 531 bp, Homo sapiens
  misc_feature: GZ8MTXP01DIUYF.13.34.D01.1.454.CMB.2.raw
  modified_base (220)..(220): a, c, t, g, unknown or other
  modified_base (303)..(303): a, c, t, g, unknown or other
  modified_base (358)..(358): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcacctgtctgtgtctccagggaatagcaacctntcctgcagggccagtcagagtgttagcagcagcttagcctggaccagcagaagcctggccaggctcccaggctcctcatttanggtgcatccacgtagggccacgtggtctccagtcaggttcaagcgcagtgggtcngggacagcttcactctcacatcagcagcctgcagtctagtaagtagttttgctagttctattactgtcagctagtatagttactggtaacgaccgttcggaccgtaaaggggcttaacggacgttagggtaagtaaagttaaaacggaacgtgggttaggtccgttgtaaccc

SEQ ID NO: 390673 - DNA, 522 bp, Homo sapiens
  misc_feature: GZ8MTXP01BF9I2.13.34.D01.1.454.CMB.2.raw
  modified_base (305)..(305): a, c, t, g, unknown or other
  modified_base (404)..(404): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaacctctcctgcagggccagtcagagtgttagcagcagcttagcctggaccagcagaagcctggccaggctcccaggctcctcatttanggtgcatccatagggccactggtctcccagtcaggttcaagcggcagtgggtctggggacagacttcactctcacatcagcagctgcagtctagaagtnttttagctagtacttattactgtcagctagtatagtctaaggagaaccgttcggccgaaaggggacacggacgttggaagtaagttaaacggaacgtggttagggtaacttggaaccc

SEQ ID NO: 390674 - DNA, 544 bp, Homo sapiens
  misc_feature: GZ8MTXP01CVIDM.13.34.D01.1.454.CMB.2.raw
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggcctccccaggcctcctctattttanggtgcatcccacgtacgggccacgtggtccgtccccagtcaggttcaaggcggcgaggtggggtctggggacaggacttcactctcacatcagcagcctgcagtctgaagttagttttgctagttctattactgtcagctagtatagttacgtaaggtacgttaccgttcggaccgaaagggcaacggcgttaggaagtaaagttaaaggacgtggttacggtcgttgaacc

SEQ ID NO: 390675 - DNA, 558 bp, Homo sapiens
  misc_feature: GZ8MTXP01CDTKN.13.34.D01.1.454.CMB.2.raw
  modified_base (302)..(302): a, c, t, g, unknown or other
  modified_base (388)..(388): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccacggcccccaggcctccncatctacgatgtatcgaggacgaccactgacactcccagacaggtcaagtggcaggtgggtctggggacagacttcactctcaccntcagacagactggaaacctgaaacgtactttgactttacttttatttcctgtaccaaccgtagttaatacgggtaacttggtcggtactggaacctaccgttattcttgttcctcttacttcccttccccgtctacttccgttgtacgttacggtaaccgttgtaaccgg

SEQ ID NO: 390676 - DNA, 530 bp, Homo sapiens
  misc_feature: GZ8MTXP01BDYFQ.13.34.D01.1.454.CMB.2.raw
  modified_base (223)..(223): a, c, t, g, unknown or other
  modified_base (305)..(305): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctntcctgcagggccagtcagagtgttagcagcagcttagctggaccagcagaagcctggccaggctcccaggctcctcatttanggtgcatccactagggccacgtggtccgtccccagtccgaggttcaaggcggcgagtgggtctgggacagacttcactctcaccatcagcacgcctgcagtctagaagtatttgctagtcttattactgttcagctagtatagttactggtacgttaaccgttcggaccgaagggacacgttacgttagggaagtagttaaaggacgtggttaggtcttggaacc

SEQ ID NO: 390677 - DNA, 539 bp, Homo sapiens
  misc_feature: GZ8MTXP01COYAG.13.34.D01.1.454.CMB.2.raw
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgtagcagcagctagcctggaccagcagaacgcctggccaggcctcccaggcctcctctatttatggtncatccacgtacgggccagtggtcctccagtcagtcaaggcgcaggtgggtctggggacagtacttcactctcaccatcacgcacgctgcagtcgtagtaagtgtttgactagttctaattctgtcaagctaagtattacgttgtaaggtaacgttaccgttcggaccgaaagggacaacggacgttagggaagtaaagttaaacggacgtgttacggtcttgtaacc

SEQ ID NO: 390678 - DNA, 721 bp, Homo sapiens
  misc_feature: GZ8MTXP01AVEW8.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagctagcctggaccagcagagcctggccaggcctcccaggcctcctctatttatggtgcatccacgtagggccacgtggtcgtcccagtcaggttcaaggccggcgtagggtcggggtcgttggggacaggtaacctttccgaccttccttaccaaccctaacttaccgaacggtcccgaacggtaccccgttcgggaccgtaacgggttcccgttaaggttaaaggttaacggttttttacggggaccttaacgggtttacctttaaacgtttaaccttcggttaccgtaacgggtaccttaaaggtttaaacgtttaacggtttaaccggtaacggggtaaaccggttaaacccggtttaccggggaacccgtaaaacggggggaaccttaaccgggttacggttaggggtaaagttaaaggttaaaacgggtaacgttagggttacggtcgttaacggtaacccg

SEQ ID NO: 390679 - DNA, 518 bp, Homo sapiens
  misc_feature: GZ8MTXP01B1MB0.13.34.D01.1.454.CMB.2.raw
  modified_base (298)..(298): a, c, t, g, unknown or other
  modified_base (304)..(304): a, c, t, g, unknown or other
  modified_base (308)..(308): a, c, t, g, unknown or other
  modified_base (355)..(355): a, c, t, g, unknown or other
  modified_base (365)..(365): a, c, t, g, unknown or other
  modified_base (382)..(382): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctccagctctnattagnggtncatccacgtacgggccacgtggtcctcccagtcgaggttcaagcggnaggtgggtcngggacagtcttcactcncacatcagcacgctgcagtactagaagttagtttgctagttcttattctgtcagctagtatagttactggaacgttaccgttcggacgaaagggcacgcgttaggaagtagtaaacggactggttagcgttgaacc

SEQ ID NO: 390680 - DNA, 514 bp, Homo sapiens
  misc_feature: GZ8MTXP01DH7QU.13.34.D01.1.454.CMB.2.raw
  modified_base (306)..(306): a, c, t, g, unknown or other
  modified_base (408)..(408): a, c, t, g, unknown or other
tcagtcacgtactacacgaccggtgctcgatttagatcgtctgtgttgggtttgggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctcctcatttanggtgcatccactagggccacgtggtcgtcccagtcaggttcaagcgcagtgggtctggggacagacttcactctcacatcagcagcctgcagtctagaagtnttttgctagttctattactgtcagctagtatagttactggattaccgttcggaccgaaagggacacggacttagggaagaagttaaaggaactgaggtcttgaacc

SEQ ID NO: 390681 - DNA, 501 bp, Homo sapiens
  misc_feature: GZ8MTXP01BI5OS.13.34.D01.1.454.CMB.2.raw
  modified_base (352)..(352): a, c, t, g, unknown or other
  modified_base (427)..(427): a, c, t, g, unknown or other
  modified_base (464)..(464): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaacctctcctgcagggccagtcagagtgtagcagcagcttagcctggaccagcagaagcctggccaggcctcccaggcctcctcatttatggtgcatccagtacggccactggtcctcccagtcaggttcaagcgnagtgggctgggacagacttcactctcacatcagcagcctgcagtctagaatgtttgctagtctatactgtcagtntagtatgtagtgtacgttacgtcgacgaaggacacgngttaggaagtaagtaacggagtggttcgtcgttgaac

SEQ ID NO: 390682 - DNA, 551 bp, Homo sapiens
  misc_feature: GZ8MTXP01AY2BG.13.34.D01.1.454.CMB.2.raw
  modified_base (301)..(301): a, c, t, g, unknown or other
  modified_base (305)..(305): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaaatagcaacctctcctgcagggccagtcagagtgttagcagcagctagcctggaccagcagagcctggccagctccaggctctctatttanggtncatccacgtagggccagtggtcctccagtcgaggttcaagcggcgaggtgggtctggggacaggtacttcactctcaccatcagcagctgcagtctagtaagttgtttcgactagttacttaattcgtcgtacgagtacgtaagttagttaggttacgtaagggtaacgttaccgtcggaacggaaagggtacacggttacggttaggtaagtaagttaaacggagtggttacgtcgttcgaaccg

SEQ ID NO: 390683 - DNA, 519 bp, Homo sapiens
  misc_feature: GZ8MTXP01DBWWK.13.34.D01.1.454.CMB.2.raw
  modified_base (224)..(224): a, c, t, g, unknown or other
  modified_base (307)..(307): a, c, t, g, unknown or other
  modified_base (330)..(330): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctntcctgcagggccagtcagagtgttagcagcagcttagctggaccagcagaagcctggccaggcctcccaggctcctcatttanggtgcatccataggccatggtcncccagtcaggttcaagcgcagtgggtctggggacagtactcactctcacatcagcagcctgcagtctagaagtagttttgctagtctattactgtcagctagtatagttctaagagttaccttcggacgaacgggacacgacgttagggaagtaaagttaaaggaacgtggttacgtaacgttggaacc

SEQ ID NO: 390684 - DNA, 558 bp, Homo sapiens
  misc_feature: GZ8MTXP01BLWXY.13.34.D01.1.454.CMB.2.raw
  modified_base (310)..(310): a, c, t, g, unknown or other
  modified_base (314)..(314): a, c, t, g, unknown or other
  modified_base (385)..(385): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctccccgaggcctcctcatttanggtncatccacgtagggccagtcggtctcccagtcaggtcaagcgcagtgggctgggacagacttcactctcacntcagcagtcctgcagtctagaaacgttgttttcgactaggttacttattaccgtgttcagtctaggtatacgttcgaaggaacgttaccgttcggaccgtaaaggggcaaccggttagttagggtaaagtaaagttaaacgggtaacgtagggttcgtaacgttggtaacccg

SEQ ID NO: 390685 - DNA, 534 bp, Homo sapiens
  misc_feature: GZ8MTXP01B6ZX8.13.34.D01.1.454.CMB.2.raw
  modified_base (306)..(306): a, c, t, g, unknown or other
  modified_base (388)..(388): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctctcatttanggtgcatccacgtagggccacgtggtcgtcccagtcaggttcaagcgcgagtgggtctggggacaggacttcactctcaccntcagcagcctgcagtctagaacgtagtttgctagttctagttctgtcagctagttatagttacgtggaagttaccgttcggaccgtaaagggcaacggcgttagggaagtaagttaaagggaacgtggttacggtcgttcggaacc

SEQ ID NO: 390686 - DNA, 600 bp, Homo sapiens
  misc_feature: GZ8MTXP01A122U.13.34.D01.1.454.CMB.2.raw
  modified_base (314)..(314): a, c, t, g, unknown or other
  modified_base (594)..(594): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtctccagtcaccctgtctgtgtctccaggggaaatagcaaccctctcctgcagggccagtcagagtgttagcagcagcttagcctggaccagcagaacgcctggccaggcctcccgaggcctcctctatttagnggtgcctagtcccgacgtacggggcctacgtcgggtccgtaccccgtagtccgtaacgggttcaaacgggcgggtccgtagggttcggggtcgtcggggacacggtacttcactctaccaccatcagacgacgcctgcagtctaggaattagtttcgacgtacgttacttacttacgtgttaccagtctaagtagttaacgttacgtaaggtaacgttaccgttcggaccgaaaggggaccaggttcgttaggaagtaacgtaaaggactgggacgtcgngtaacc

SEQ ID NO: 390687 - DNA, 540 bp, Homo sapiens
  misc_feature: GZ8MTXP01C8SKG.13.34.D01.1.454.CMB.2.raw
  modified_base (303)..(303): a, c, t, g, unknown or other
  modified_base (309)..(309): a, c, t, g, unknown or other
  modified_base (313)..(313): a, c, t, g, unknown or other
  modified_base (423)..(423): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaaggggaaatagcaaccctctcctgcagggccagtcagagtgttagcagcagcttagcctggaccagcagaagcctggccaggcctcccaggctcctnatttanggtncatccacgtagggcctacgtggtccgtccccagtcaggttcaagcgggcagggtggggtctggggacaggaccttcactctcaccatcagcagcctgcagtctagaagtnttttgctagtcttattactgtcagctagtatagttactggtaacgttaaccgtcggacgaaaggggaacacgacgttagggaagtaagttaaaggactaggttcgtcgttcggaacc

SEQ ID NO: 390688 - DNA, 642 bp, Homo sapiens
  misc_feature: GZ8MTXP01B3VBQ.13.34.D01.1.454.CMB.2.raw
  modified_base (315)..(315): a, c, t, g, unknown or other
  modified_base (319)..(319): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctaccgaaggggaaatagccaacctctcctgcagggccagtcagagtgtagcagcagtctagcctaggaccagcagaacgccgtggccaggctcccgagctcctactagtttanggtnacactccacgtacggccagtcggtcctacccagtccgtaggttcaaggccgggtcgagggttggggtcgtaggggaacctacggtaccttcacccttctaccaaccagtaccaggacccgcgcctacgacgtagtactagtaagttgtttcgacttacgttacttaagttcgtgtacgtacgtacgtaagttaacgttacggttaacgtaacgggtaaccgttaacccggtacggaaaccggtaaacggaacgttaacggttacggttaagggtaaacgttaaaggtaaacggtacgttagggttacgtcgttaacgtaaccg

SEQ ID NO: 390689 - DNA, 554 bp, Homo sapiens
  misc_feature: GZ8MTXP01AHV40.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccgaggctcctcatttatggtgcatccacgtagggccacgtggtccgtccccagtccgaggttcaagcgggcagggtgggtctggggacaggacttcactctccaccatcagcagcctgcagtctagtaagtatttgctagtcttattactgtcagctagttactagttacgtaaggtacgttaaccgttcgggaccgaaacgggacgaacggcgttagggtaagtaacgttaaaggtacgtaggttacggcgttcggaacccg

SEQ ID NO: 390690 - DNA, 819 bp, Homo sapiens
  misc_feature: GZ8MTXP01BWILR.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaacctctcctgcagggccagtcagagtgttagcagcagcttagcctggaccagcagaacgcctggctaggcctcccgaggcctcccgtctaattttagtgggtgccactcccgacgttaacgggggcccaaccggtttcggggttccccgtacccccgtaaggttcccgtaacggggtttccgaaacgggcccgggtccgtaaaggggtttcgggggttaccggttacgggggaaacctaacgggtaccctttacccgtacccttaccttaccaaaccccgtattacccgaacggaccaaccggtcccgtacggacctaaacgggttccttaagggttaaacggtttaggttttttacgggacccgtttaagttacccgtttaactttaaccgttcggttactaacgggtaccttaaaggtttaaacgtttaaggtttaaccgtaacgggggttaaaccgttaaccccgggtttacccgggaaacccggttaaaaccgggggtaaccgaacccgggttaaccggttaaggggtaaacgttaaaagggtttaaaaccgggtaacggttagggttacgggtaaccgttaacgggtaaccccg

SEQ ID NO: 390691 - DNA, 578 bp, Homo sapiens
  misc_feature: GZ8MTXP01C3ORU.13.34.D01.1.454.CMB.2.raw
  modified_base (310)..(310): a, c, t, g, unknown or other
  modified_base (314)..(314): a, c, t, g, unknown or other
  modified_base (387)..(387): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtctccagtcaccctgtctgtgtctccgaaggggaaatagcaacctctcctgcagggccagtcagagtgtagcagcagctagcctggaccagcagaacgccgtgccaggcctcccaggctcctctatttanggtncaatccagtaggccacgtggtctccagtcaggtcaagtcgcgaggtgggctgggacagcttcactctcacacncacgcacgctcgacgtagtactagtaagttcgtttacgacgttacgttacttagttacgtgtacgagtactaagttaagttacgttaacgtaacggtaacgttaaccgtacggaaccgaaacggaaccgacggttaacgttagggtaaagtaaaggttaaacggtacgttaggttacgtaacgttcgaacc

SEQ ID NO: 390692 - DNA, 598 bp, Homo sapiens
  misc_feature: GZ8MTXP01DVP3V.13.34.D01.1.454.CMB.2.raw
  modified_base (317)..(317): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaacctctcctgcagggccagtcagtagtgtagcagcagcttagcctggaccagcaagaacgccgtggccaggcctcccaggcctcctctatttagtggtcnctactccacgtacgggccacgtcggtcgtccccagtcgtaggttcaagggcggcgagggttggggtcgtaggggacaggtacctttacactctaccaccatccagacacgctgcagtcgtagaagtttgtttcgacttagttacttaacttcgtgtacgagtacgttaagttacgttacggtaacgtaaggtaacgttacccggttacggaaccgtaaacggtacgacggttacgttagggtaagtaaagttaaacggacgtggttacgtcgttcgtaacc

SEQ ID NO: 390693 - DNA, 765 bp, Homo sapiens
  misc_feature: GZ8MTXP01DGJM9.13.34.D01.1.454.CMB.2.raw
  modified_base (224)..(224): a, c, t, g, unknown or other
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatgcaaccctntcctgcagggccagtcagagtgtagcagcagcttagcctggaccagcagaacgccgtggccaggcctcccgaggtcctcctctatttagnggtcgctactccgacgtacgggcctacgtcggtccgtcccgagtcgtacgggttcgaaacgggccgggtcgtaagggttcggggttaccgttacgggggaacctaacggggttaccctttaccgacccgtttaccgttacccaacccgtacgttaccgaacggaccgtaaccgggtcccgttacggaccgtaacggttcccgttaagggttaaacggtttacggttttttacgggaaccttaaccgggtttactttaaacgtttaacccgttcggttaccgtaaacggtaccgttaaggtttaacgttaacggtttaacggtaacggggttaaaccgttaacccggtttacggggaaacccgtaaacgggggtaaccttaacgggttacgttagggtaaacgtaaacggtttaaacgggaacgttgggttacggtaacgttcggtaacccg

SEQ ID NO: 390694 - DNA, 593 bp, Homo sapiens
  misc_feature: GZ8MTXP01EPRES.13.34.D01.1.454.CMB.2.raw
  modified_base (310)..(310): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaacctctcctgcagggccagtcagagtgtagcagcagcttagcctggaccagcaagagcctggccaggcctcccgaggcctcctctatttanggtgcatccagttacgggccctacgtggtcccgtacccagtcgtaggttcaacggcgggcgtagggtcggggtctaggggactaggtacttcactctacaccatcagcacgtcctgcacgtctagaacgttgttttggactagttcttaattactgtacgagcttaagtagttaacgttagtaagggtaacgttacccggttacggaccgaaacgggaccgttaacgggacgttaggggtaacgtaagttaaaacgggagtggttacggtaacgttcggaacc

SEQ ID NO: 390695 - DNA, 587 bp, Homo sapiens
  misc_feature: GZ8MTXP01EU92T.13.34.D01.1.454.CMB.2.raw
  modified_base (361)..(361): a, c, t, g, unknown or other
  modified_base (371)..(371): a, c, t, g, unknown or other
  modified_base (454)..(454): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggagcagctccaacagttggggcacattatgatgtacactggtaccagctagtttccgaggacgcacggtccccagtacctcctcatacaaatagtaaaccaaacaacgtccggacccgacgacgggggtccctacgaccgtattcnctggcctcgnggtctggccacctcacgccctccctgtcatcacgtcgggactccgagtctaggaggatggaggcttagggtatttacgtttcncgtacctagtccctatcgaactcgactcgcgtggtcgttcgtcggtttacgggtacggttccgggggaccggggccgacggtccgtaccggtaaccggttccggtacggttaccgtaaccgttcccggaacgg

SEQ ID NO: 390696 - DNA, 524 bp, Homo sapiens
  misc_feature: GZ8MTXP01BK13O.13.34.D01.1.454.CMB.2.raw
  modified_base (307)..(307): a, c, t, g, unknown or other
  modified_base (311)..(311): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctcctcatttanggtncatccactagggccactggtctcccagtcaggttcaagcgcagtgggtctgggacagacttcactctcacatcagcagcctgcagtctgaagagtttgctagtctattactgtcagctagtatagttactggtagaaccgtttcggccgaaagggacaacggccgttagggaagtaagtttaaagggaactggttacgggtccttggaacccg

SEQ ID NO: 390697 - DNA, 539 bp, Homo sapiens
  misc_feature: GZ8MTXP01BWUKA.13.34.D01.1.454.CMB.2.raw
  modified_base (246)..(246): a, c, t, g, unknown or other
  modified_base (275)..(275): a, c, t, g, unknown or other
  modified_base (295)..(295): a, c, t, g, unknown or other
  modified_base (303)..(303): a, c, t, g, unknown or other
  modified_base (305)..(305): a, c, t, g, unknown or other
  modified_base (328)..(328): a, c, t, g, unknown or other
  modified_base (348)..(348): a, c, t, g, unknown or other
  modified_base (401)..(401): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaaggggaaatagcaaccctctcctgcaggccagtcagagtntagcagcagctagcctggaccagcagaancctgccaggctccaggctcncatttagngncactcagtacggctacgtgtccnccagtcgtagtcgaacgcgngtaggtcgggtcgtacgggacacgtacttacactctacacatcgagctacgcncgcgtagtacgtagtaagtagttagtacgtacgtacttacttacgtgtacgtagtacgtagtagtagtagtaacgtacgttacgtacgacgaacggacgacgacgagtaagtaagtaagacgtagttacgtcgcgtcg

SEQ ID NO: 390698 - DNA, 649 bp, Homo sapiens
  misc_feature: GZ8MTXP01C8YZV.13.34.D01.1.454.CMB.2.raw
  modified_base (311)..(311): a, c, t, g, unknown or other
  modified_base (315)..(315): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcaggccagtcagagtgttagcagcagcttagcctggaccagcagtaagcctggccaggcctcccaggcctcctacatttanggtncaactccaacgttacggggccaacgttgggtcccgttaccccgagtccgaaggggtttcaaacgggcggtcgtagggtggggtacctagggggaacctaggacctttcaacttctaccaccctaactaccgacgacacgtcctacgactacgttacgtaagtaagttacgtttacgacgttagttacttaacttacgtgtacacgtacgtaagttaagttaacgttaacgtaacggtaacgttaaccgttaccggttaaccggtaaacggaacgaacgttacgttaggtaagtaaagtaaacggtaacgtacggttacggtcgttaacgtaacg

SEQ ID NO: 390699 - DNA, 611 bp, Homo sapiens
  misc_feature: GZ8MTXP01EQU16.13.34.D01.1.454.CMB.2.raw
  modified_base (312)..(312): a, c, t, g, unknown or other
  modified_base (316)..(316): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaacctctcctgcaggccagtcagagtgttagcagcagcttagcctggaccagcagaagccgtggccaggcctcccgaggcctcctctatttagnggtnctactccgacgtacgggccacgtcggtccgtcccgagtcgtaggttcaagggccggcgtagggtcggggtcgtagggggaacctaggtacttccactcctaccaacctatcgacgcacgtcctgcagtctagaagttagttttgactagttacttaattacgtgtacagactaaggttaattacgttaacgtgggtaacgttaacccggttacggaaccgtaaacgggtacaaccggttacgttagggaaagtaagttaaaacgggacgttagggttgggtaacttcggaacccg

SEQ ID NO: 390700 - DNA, 562 bp, Homo sapiens
  misc_feature: GZ8MTXP01BD3G1.13.34.D01.1.454.CMB.2.raw
  modified_base (312)..(312): a, c, t, g, unknown or other
  modified_base (316)..(316): a, c, t, g, unknown or other
  modified_base (365)..(365): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggaccagcagaacgccgtggccaggcctcccaggcctcctcatttanggtncatccagtacgggccacgtggtcgtccccagtcaggttcaagggccggnaggtggggtctggggacaggacttcactctcacatcagcagcctgcagtctagaagttgtttggctagttctattacgtgtcaagtctaagttattacgttacgtgggtaacgttaaccgttcgggaccgtaaagggaccacggttacgttacgggaagtaagttaaacggacgtggttacgggtcgttcggtaacc

SEQ ID NO: 390701 - DNA, 574 bp, Homo sapiens
  misc_feature: GZ8MTXP01BBAN1.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgtagcagcagcttagcctggaccagcagaacgccgtggccgaggcctcccgaggcctcctctatttagtggtgctatccgacgtacgggcctacgtggtccgtcccagtcgaggttcaaggcggcgagggtcgggtcgtggggacagtacttcactctcaccatcagcacgcctgctagtctagtaagttagtttgctagttacttattacgtcgtacacgtcgtaagttacttagttacgaagggtaacgttaccggttcggaccgaaagggacaacggttcgttagggaagtaagttaaacgggacgtgggttacgtcgttcggaacc

SEQ ID NO: 390702 - DNA, 776 bp, Homo sapiens
  misc_feature: GZ8MTXP01A2IHT.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgtagcagcagcttagcctggaccagcagaagcctggccaggcctccccgaggtcctccgtctattttagtcgggtgctactcccacgttacggggccctacgtcgggtccgtccccgaggtcgtagggtttccaaagggccgggcgtaagggtcgggggttacgtacgggggaacctacggtacctttccgacctcctacccaaccctatccgacgccgacgccctggcctaagttccgttaggtaaagttaggttttttacgggacttaacggttacctttaactttaaccgttcggtttacccgaaagggttacctaaaggtttaagtttaaacgggttttaacccggttaagggggttaaacccggttaaaccccggttttacccgggggttaaacccggtaaaacggggggtaaacccgttaaaccggggttaaccgggtttaaagggggaaaaccggttaaaacgggtttaaaaaggggtaaacccgttagggggttacggggtaacccgttcggggtaaccccg

SEQ ID NO: 390703 - DNA, 732 bp, Homo sapiens
  misc_feature: GZ8MTXP01AJN0T.13.34.D01.1.454.CMB.2.raw
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccaccctgtctgtgtctccgaggggaaatcgcaaccctctcctgcagggccagtcagagtgtagcagcaggctagcctggaccagcagagcctggccaggcctcccgaggcctcctctatttagnggtgcactccgacgtacgggcctacgttggtccgtaccccgaggttcacgggttcaacgggccgggtcgtagggtcgggggtcgtcgggggaacacggtacctttccgaaccttctaccaccaactccgaacggtccacggcccttcgggacctaggttaccgtagggtaaattacggtttttcggaccttaaggtttacctttaactttaaccgtgggtttaccaagggttcctaaaggtttaagttaaacgggttttaccgaaggggtaaacccggttaaacccgtttaccggggaaacccgttaaacggggggtaacccaacccggggttagggtttaaccggggaaaggttaaaaccgggtttaaaaacgggggaacccgtttgggggtttaaccgggcctttccgggtaaacccg

SEQ ID NO: 390704 - DNA, 582 bp, Homo sapiens
  misc_feature: GZ8MTXP01AXHDZ.13.34.D01.1.454.CMB.2.raw
  modified_base (302)..(302): a, c, t, g, unknown or other
  modified_base (310)..(310): a, c, t, g, unknown or other
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcgaggggaaatagcaacctctcctgcagggccagtcagagtgttagcagcagcttagcctggaccagcagaacgccgtggccaggcctccgagctcctntatttagnggtncactccacgtacggccacgtggtccgtccagtcgaggttcgaaggtcggcgagggtggggtcgtgggactagtcttcactctacacactcagacacgctacgctacgtcgtagtaacggtattttagacgttagttaccttaattaccgtgttacgacgtgtaagttagtacgtttaccggtaaggtacgttaaccgtttacggacgtaaacgggacaccgagttaggtaagtaagttaaaggtacgtgttcgggtaacttcggaacc

SEQ ID NO: 390705 - DNA, 502 bp, Homo sapiens
  misc_feature: GZ8MTXP01EK09G.13.34.D01.1.454.CMB.2.raw
  modified_base (310)..(310): a, c, t, g, unknown or other
  modified_base (417)..(417): a, c, t, g, unknown or other
  modified_base (473)..(473): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaaatagcaaccctctcctgcagggccagtcagagtgtagcagcagcttagcctggaccagcagaagcctggccaggctcccaggcctcctcatttatggtncatccacgtagggccactggtcctcccagtcaggttcaagcggcaggtgggtctggggacagacttcactctcacatcagcagcctgcagtctagtaagtagttttncgtattctattactgtcagctagtatagtcgtgtagacgttcgaccgaggacacgnttaggaagataaggactgttggcttgaac

SEQ ID NO: 390706 - DNA, 543 bp, Homo sapiens
  misc_feature: GZ8MTXP01EK9B5.13.34.D01.1.454.CMB.2.raw
  modified_base (307)..(307): a, c, t, g, unknown or other
  modified_base (311)..(311): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcaggggaatagcaacctctcctgcagggccagtcagagtgttagcagcagcttagcctggaccagcagaagcctggccaggcctcccgaggcctctcatttagnggtncatccagtacgggcctacgtggtccgtcccaggtctaggttcaacggcggcgtagggtcggggtctcggggacaggtacttcactctacaccatcagcagcctgcagtctagagtatttgcgtagttctattactgttcagctagtatagttactaaggtacttaaccgttcggacgaaaggtacgacgcgttaggaagtaagttaaacggacgtggttacggtcttgaacc

SEQ ID NO: 390707 - DNA, 807 bp, Homo sapiens
  misc_feature: GZ8MTXP01DTOVU.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctccagatactactggagaaatagtgctgacgcagtctccagtcacctgtctgtgtctcgagggaatagcacctctctgcagggccagtcagagtgtagcagcagtcttagcctggaccagacagaacgccgtggccacggcctccccgaggtccctcctactacgttttagtcgggttcgactactcccgtacggtacggggccctacggttcgggttccgtacccccgtaggttaccgtacggggtttaccgaaacgggtcccgggtcggaaggggtttccgggggttccgttacggggggaaccgtaacgggttaccgtttaccctaacccgttcccgttacccaaacccgtacttaccgaacggacccgtaaccggtcccgttacgggaccttaacgggttaccgttaaacggggttaaacgtttacggttttttacggaaccgtttaacggtttaccgtttaaatttacccgttagggttacctaaacggtaccgttaaaggtttaaaccgttaagggtttaacggtaacgggtaaaccgttaaacccggttaccggggaacccggtaaacgggaccgttaaaccgggttaacggttacggggtaaagttaaacggttaaacgggtaccggttgggttacggtaaccgttcggaacccg

SEQ ID NO: 390708 - DNA, 523 bp, Homo sapiens
  misc_feature: GZ8MTXP01DM52H.13.34.D01.1.454.CMB.2.raw
  modified_base (306)..(306): a, c, t, g, unknown or other
  modified_base (310)..(310): a, c, t, g, unknown or other
  modified_base (443)..(443): a, c, t, g, unknown or other
  modified_base (445)..(445): a, c, t, g, unknown or other
  modified_base (448)..(448): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgcctactctggctcccagatactactggagaaatagtgctgacgcagtctccagtcaccctgtctgtgtctccaggggaaatagcaaccctctcctgcagggccagtcagagtgtagcagcagcttagcctggaccagcagaagcctggccaggctcccagctctctatttanggtncatccacgtacgggccagtcggtccgtccccagtcgaggttcaacggcggcgtagggtcgggtcgtggggacaggtacttcactctacacatcagcacgcctgccagtctagagtatttgctagtctatactntnatntatatagtagtgacgttacgtcgacgaaggcacgcgttaggaagtaaagtaaggacgtggttacgtcgttcgaac

SEQ ID NO: 390709 - DNA, 564 bp, Homo sapiens
  misc_feature: GZ8MTXP01A2EHH.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcaggggaatagcaacctctcctgcagggccagtcagagtgttagcagcagcttagcctggaccagcagaagcctggctaggctcccaggcctcctcatttatggtgcatccatacgggccacgtggtctcccagtcaggttcaagggcggctaggtgggtctggggacagtacttcactctcacatcagcagcctgctagtctagtaagtagtttcgctagtccttagtttacctgtaccagtcgtaagttattacgttacgtgggtaacgttaaccgttcgggaccgaaacggggtaccaacgggttacgttagggaacgtaaagttaaacgggacttaggacgggtcgttggtaacccg

SEQ ID NO: 390710 - DNA, 558 bp, Homo sapiens
  misc_feature: GZ8MTXP01EMXUK.13.34.D01.1.454.CMB.2.raw
  modified_base (472)..(472): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcaggggaatagcaacctctcctgcagggccagtcagagtgtagcagcagcttagcctggaccagcagacgcctggccaggctcccgaggcctcctctatttagtggtgcatccgacgttacgggccacgtggtcccgtcccagtcgaggttcaagggcgggcgtagggtcgggtcgtaggggacaggtactttccactctcaccatcgagcacgcctgcagtctagtaagttatttgctagtcttattctgtcagctagtatagttcgnggtaacgttaccgttcggaccgaaaggggacacggttcgttagggaagtaaagttaaagggaacgttgggaggtccgttgtaaccc

SEQ ID NO: 390711 - DNA, 623 bp, Homo sapiens
  misc_feature: GZ8MTXP01A42PP.13.34.D01.1.454.CMB.2.raw
  modified_base (224)..(224): a, c, t, g, unknown or other
  modified_base (586)..(586): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagcaaccctntcctgcagggccagtcagagtgttagcagcagcttagcctggaccagcagaacgcctggccaggcctcccgaggcctcctcactctacgatgtattcgagggacgaccacgtgaacccctacgtaccaaggacctagggtttaccagggttggaccgtaagggttcggggtcgtaggggaactaggtacccttcacttacctacacctactacaacgtacgaacgtacgttacgggaacctaggtaacgtacctttcgggactttaacttttactttacgtcgtacctacgtagttagttcggtacggtacctaccggtacttaacgtttcgggaccgtacggggacaacggtcgttagganacgtaacgaagcgtaacgtggttacgcgttgtaaccg

SEQ ID NO: 390712 - DNA, 601 bp, Homo sapiens
  misc_feature: GZ8MTXP01BEHXO.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaatagcaacctctctgcagggccagtcagagtgttagcagcagcttagcctggaccagcagaagccgtggccaggcctcccgaggcctcctctatttagtggtcgcactccaacgttacgggccacgtcggtccgtccccgagtccgaggttcgaacgcgggcgagggtggggtcgtggggactacggactttccgacttctaccaccatccgagactcgccctggcacgtctagtaacgtagttttgactagttaccttattcctgtacagctaagttattaagttcgtaagggtaacgttaaccgttacgggaccgaaacgggtaccgaaccggttagttacgggaagtaaaggttaaaacgggaagtcggttagggtaacttcggaacc

SEQ ID NO: 390713 - DNA, 645 bp, Homo sapiens
  misc_feature: GZ8MTXP01DGD87.13.34.D01.1.454.CMB.2.raw
  modified_base (321)..(321): a, c, t, g, unknown or other
tcagtcacgtactacacgaccggtgctcgatttagatcgtctgtgttgggtttggggagagctctgggggaggaactgctcagttaggacccagacggaaccatggaagccccagcgcagcttctcttcctcctgctactctggctcccagatactactggaagaaatagtgctgacgcagtctccagtcaccctgtctgtgtctccgaaggggaaatagccaaccctctcctgcagggccagtcagtagtgttagcagcagcttagcctggaccagcagaacgccgtggccaggcctccccgaggcctcctctatttagnggtgctatccgacgtacgggcccacgtcgggttcccgtaccccaaggttccgtaacgggtttccaaacgggcgggcggtaagggttcgggggtccgttagggggaacctagggtacctttaccaccttcctaccaccacttcaacggcaacggtccctacggcgtacggttctaaggtaagttagtttttacgcgttaagttacttatttacgtgtacagctaagtattagttacgtaaggtaacgttaaccgttcggaccgtaaaggggcaacggcgttaggaacgtaaagttaaacggaacgtggttaggtcgttcggaacc

SEQ ID NO: 390714 - DNA, 538 bp, Homo sapiens
  misc_feature: GZ8MTXP01EIMDD.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagcttagcctggaccagcagaacgccgtggccaggcctcccgaggtcctcctctattttagtggtgcatccgacgtacgggccacgtggtccgtccccagtcaggttcaaggcggcgaggtgggtctggggacaggtacttcactctcaccatcagcagcctgcagtctagaagtatttgctagtctattactgtcagtctagtatagtagtggacgttaccttcggacgaaagggtacacggcgttaggaagtaagttaaaggactggttcggtcgttcgaacc

SEQ ID NO: 390715 - DNA, 757 bp, Homo sapiens
  misc_feature: GZ8MTXP01AFORG.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaacctctcctgcagggccagtcagagtgttagcagcagcttagcctggaccagcagagcctggccaggcctcccgaggcctcctctatttagtggtcgcacgtccacgttacgggcctacgtggttccgtccccgaggttcgtacggttcgaaacgggtccgggcgtagggttcgggggttcgttacggggggaacctacggtaccctttacccgtaacccgttccttacccgtaaccccgaacgttacccaacggtacccgaacgggtccccttcggaccgtaaacgttccgtaacggtaaacgttaaggttttttcggacgttacggtttaccctttaaagtttaccgttgttaccgtaagtaccgttaaggtttaacgtttaacggtttaacggtaacggggtaaaccggttaaacccggtttacgggaaacccggtaaacgggggtaaccgaaccgggttaaccggttacggggtaaacggtaaaaggtttaaaacggggtaacggttagggttacgggtccgttcggtaacccg

SEQ ID NO: 390716 - DNA, 573 bp, Homo sapiens
  misc_feature: GZ8MTXP01CSMJC.13.34.D01.1.454.CMB.2.raw
  modified_base (280)..(280): a, c, t, g, unknown or other
  modified_base (309)..(309): a, c, t, g, unknown or other
  modified_base (313)..(313): a, c, t, g, unknown or other
  modified_base (430)..(430): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatagccaacctctcctgcagggccagtcagagtgtagcagcagcttagcctggaccagcagaagcnggccaggctcccaggctcctctatttagnggtncactccacgtagggcccacgtggtccgtacccagtcgaggttccgaaaggccgcgagggtgggtcgtaggggaccagtactcactcacaccatcagcagcctgcagtctagaagttntttgctagttctaattctgtcaagctaagtataagttacgaaggtaacgttaacccgttcggaacccgaaaggggaaccaccggttacggttagggaaagtaaagttaaaacgggaacttgggttacgggtcgttcgaacccg

SEQ ID NO: 390717 - DNA, 648 bp, Homo sapiens
  misc_feature: GZ8MTXP01EQ82J.13.34.D01.1.454.CMB.2.raw
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagcttagcctggaccagcagaagcctggccaggcctcccgaggctcctctatttatgggtncatccacgttacgggcctacgttgggtccgtcccccgtaaggtccgagggtttccaaacgggccgggccgtaggggttcggggttccgtagggggtaaccacgggtacctttcgaacccttcctaccaacccataccgacggaccaacggcccttaggctaacgtcgtaagtaagttagtttttacggacttaagttccttaagtttacctggttaccaagtccgtaagttacttaagttacgtaaggtaacgttaccgttacggaccgaaaggggaccaacggttacgttagggtaagtagttaaaaggacgtggttacgggtcttggaaccg

SEQ ID NO: 390718 - DNA, 529 bp, Homo sapiens
  misc_feature: GZ8MTXP01A3B5P.13.34.D01.1.454.CMB.2.raw
  modified_base (304)..(304): a, c, t, g, unknown or other
  modified_base (308)..(308): a, c, t, g, unknown or other
  modified_base (331)..(331): a, c, t, g, unknown or other
  modified_base (370)..(370): a, c, t, g, unknown or other
  modified_base (382)..(382): a, c, t, g, unknown or other
  modified_base (388)..(388): a, c, t, g, unknown or other
  modified_base (392)..(392): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagctagcctggaccagcagagcctggccaggctccaggctcctcatttanggtncatccatagggccacgtggtccncccagtcagggttcaaggcggcgagtggggtctgggacncgacttcactcnctaccntcancacgcctgcagtctagagtatttgctagtctatactgtcagctagtatagttacgtaaggacgttaacccgttcggaccgaacgggacgttaccgagttggaagtagtaaacggaagtggttacggtcttcgtaacc

SEQ ID NO: 390719 - DNA, 522 bp, Homo sapiens
  misc_feature: GZ8MTXP01C9EXT.13.34.D01.1.454.CMB.2.raw
  modified_base (248)..(248): a, c, t, g, unknown or other
  modified_base (314)..(314): a, c, t, g, unknown or other
  modified_base (442)..(442): a, c, t, g, unknown or other
  modified_base (486)..(486): a, c, t, g, unknown or other
tcagtcacgtactacacgaccggtgctcgatttagatcgtctgtgttggggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatagaccaaccctctcctgcagggccagtcagngtgtagcagcagcttagctggaccagcagaagcctggccaggcctcccgaggcctcctcatttagnggtgctactccgagtacggccacgtggtccacccagtcaggttcaagcgcgagtggggtactaggggacacgtcttcacttcacaccatcagcagcctgcagtctagaatatttgactgtctaattcngtcagctagtatgtactggacacgtcgacgaaagggcaacgttnttaggaataaagtaaggaactggttagcttggaacc

SEQ ID NO: 390720 - DNA, 578 bp, Homo sapiens
  misc_feature: GZ8MTXP01DPI22.13.34.D01.1.454.CMB.2.raw
  modified_base (221)..(221): a, c, t, g, unknown or other
  modified_base (311)..(311): a, c, t, g, unknown or other
  modified_base (369)..(369): a, c, t, g, unknown or other
  modified_base (426)..(426): a, c, t, g, unknown or other
  modified_base (472)..(472): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcagggaatagcaaccctntcctgcagggccagtcagtagtgttaagcagcagcttagcctggaccagcagaagcctggccaggctcccgaggtcctctcgtatttagnggtgctactccacgttacgggccacgtcggtcgtccccagtcgaggttcaacggcggngtaggtgggtcgtgggaaccaggtacttcacttctacaccatcaagcacgcctgacngtctagaagttatttcggcttagtaccttagttacctgtacacgtntaagtagttagttacgtaaggtaacttaccgttcgaccggaaggacccaagttaccgttagggaagtaaagttaaaccggtagtgggttacgtaacgttgtaaccc

SEQ ID NO: 390721 - DNA, 546 bp, Homo sapiens
  misc_feature: GZ8MTXP01DID4O.13.34.D01.1.454.CMB.2.raw
  modified_base (310)..(310): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggaccagcagaagcctggccaggcctcccgaggctcctcatttanggtgcatccagtacggccagtggtccgtcccagtcaggttcaagcggcaggtgggtctgggacagtacttcactctacacatcgagcacgcctgcagtctagaagtagttttgctagtcttattactgtacagtctaagtagtacgttagtaaggtaacgttaccgttacggacgtaaagggacacggttacgttaggaagtaaagtaaaggacgtggttacggtcgttcgaaccg

SEQ ID NO: 390722 - DNA, 566 bp, Homo sapiens
  misc_feature: GZ8MTXP01ACVSZ.13.34.D01.1.454.CMB.2.raw
  modified_base (517)..(517): a, c, t, g, unknown or other
  modified_base (541)..(541): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatagccaaccctctcctgcagggccagtcagagtgtagcagcagcttagcctggaccagcagaacgcctggccaggcctcccgaggtcctcctcatctacgatgtattcgaggagaccatcgaccactccgagaccgaggttaccaggtcggacgagggtggggtctaggggacaggtacccttcaactcctacaccatcgagcagacgtaggaacctagaacgtctttgggacttaacttttattcgtcgtaccaccgtagttacgtacggtaactggtacgctcgaccttactattcgttntcttcgttcttcccttcccgactnttctagttacttaagttcgtaacgg

SEQ ID NO: 390723 - DNA, 557 bp, Homo sapiens
  misc_feature: GZ8MTXP01AHBH7.13.34.D01.1.454.CMB.2.raw
  modified_base (300)..(300): a, c, t, g, unknown or other
  modified_base (308)..(308): a, c, t, g, unknown or other
  modified_base (447)..(447): a, c, t, g, unknown or other
  modified_base (452)..(452): a, c, t, g, unknown or other
  modified_base (469)..(469): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggctcccaggctccnctatttanggtgcatccatagggccagtggtctcccagtcaggttcaagcggcaggtgggtcgtggggacaggtacttcgactctcaccatcagcgacgcctgctagtctagaagtagttttgacgtagttacttatttaccgtgtnacggntaggttatagtttacgnggtaacgttaccggttacggccgaaagggaccttaacgcgttagggtaagtagttaaaacggtacgtaggttcggtcgttcggaaccc

SEQ ID NO: 390724 - DNA, 755 bp, Homo sapiens
  misc_feature: GZ8MTXP01DIY0P.13.34.D01.1.454.CMB.2.raw
  modified_base (323)..(323): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtctccagtcaccctgtctgtgtctccgaggggaaatgccaacctctcctgcgagggccagtcagtagtgtagcagcagtcttagcctggaccagcagaacgccgtggccacggcctcccgaggtcctcctactaattttacgnggtcgactactaccgacgttacgggcctacggtcggtacccgtaccccaggttacccgtacgggttaccgaacgggcccgggtcgtagggggttcgggggtaccggttacggggaaacctacgggtaacctttcccgaaccctttctaacccaaccctaattccgaaggacccgaacggtcccctagggctacggttacgtaagggtaaactttaggttttcggaaccttaaggtttacccttaaaatttccgtgtaccgtaggtaacttaaagttaaccgttagttaaacggtaacggggttaaaccgttaaaccccggtttacggggaaaccgtaaaacggggtaaccccgaaggttaccggttaagggtaaaccgttaaaaggtttaaaaccgggaacgtttgggaacgggtccttaacggtaaccccg

SEQ ID NO: 390725 - DNA, 712 bp, Homo sapiens
  misc_feature: GZ8MTXP01ELYDT.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctcagtcaccctgtctgtgtctcgaaggggaatagccaacctctcctgcgagggccagtcagagtgtagcagcagtcttagcctggaccagcagaacgcctggccaggctccgaggcctcgtactatttagtggtcgacctacgtaccaacggtacgggccctaacgttcgggtacccgtaccccgtaggtcgtaacggttccgaaagggtccggcgtagggtcggggtacgtagggggaacctaacgggtacttaccacttctaccgaacctactaccgaaggtaccaacgggtccctacggtactacggttaccgtaggtaaaacgtttggttttttacgggaccctttaaaggttaccctttaaatttaaccgttcgttaccgtaaggtaccttaaagtttaaacgttacggtttaacgaaggggtaaaccgttaaaccggttaccgggaaacgtaaacggggacttaaccggttacgttagggaaagttaaagttaaaggaacggtggttacggtcttaacggtaacc

SEQ ID NO: 390726 - DNA, 588 bp, Homo sapiens
  misc_feature: GZ8MTXP01A240C.13.34.D01.1.454.CMB.2.raw
  modified_base (318)..(318): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggacagcagaagcctggccaggcctcccgaggtcctcctcatttagtgggtcnccatccacgtacgggccacgtggtccctcccaggtctaggtcaaggccggcgtagggtggggtctggggaccaggtacttacactctaccacatcgagccagcctgctagtcgtagtaaagttattttacgacttagttacttaatttaccgtggttacaaggtcgtaagttaagttagttacgtaaggaacgttacccgttacgggaccgaaagggtacacgttacgttaggaagtaagttaaaggtacgtaggttacggtcgcgtaac

SEQ ID NO: 390727 - DNA, 573 bp, Homo sapiens
  misc_feature: GZ8MTXP01BTV9G.13.34.D01.1.454.CMB.2.raw
  modified_base (311)..(311): a, c, t, g, unknown or other
  modified_base (376)..(376): a, c, t, g, unknown or other
  modified_base (399)..(399): a, c, t, g, unknown or other
  modified_base (473)..(473): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaaccctctcctgcagggccagtcagagtgttagcagcagcttagcctggaccagcagaagcctggccaggcctcccgaggcctcctctatttagnggtcgctatccacgtacgggcctacgtggtccgtcccagtcaggttcaagcggcaggtcgggtcnggggacagtacttcactcacacntcagcagcctgcagtctagtaattgtttgactagttcttattacctgtacaggtctaaggttattacgttacgngggtaacttaacggttcgggaccgaaagggtaaccacggttacgttaggggtaacgtaagttaaaacgggcgttaggttacggtccgttaacggtaaccc

SEQ ID NO: 390728 - DNA, 532 bp, Homo sapiens
  misc_feature: GZ8MTXP01CIBV6.13.34.D01.1.454.CMB.2.raw
  modified_base (306)..(306): a, c, t, g, unknown or other
  modified_base (310)..(310): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagagcctggccaggctcccaggctcctcatttanggtncatccacgtacgggccacgtggtccgtcccagtcaggttcaaggcggcaggtgggtctggggacagactcactctcacatcagcagcctgcagtctagaagtatttgctagtctattctgtcagtctagtatagttagtggtaacgttaaccgttcggaccgtaaaggggcacggacgttagggaagtaagttaaaggacgtgttacggtcgttggtaaccc

SEQ ID NO: 390729 - DNA, 734 bp, Homo sapiens
  misc_feature: GZ8MTXP01EVYCJ.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctaccgaggggaaatacgccaacctctcctgcgagggccagtcagagttgtagcagcagtcttagccgtgaccagcagaacgcctggccacggccctcccgacggtcccttccgtacttagtttacgtggtcacctacgttacccgacggtacgggccctacggtcgggttcccgtaccccgtagtcgtaacgggttcgaaacgggccgggcgtaggggttcggggtaccgtagggggactaacggtacctttacaccttctaccacctagtccaagccacgtccgtgacgtacgttacgttaagtaaagtttcggttttacgacgttacgtttaccttaaagtttaccgttgttaacgaaccgtacggttaaagtttaacggttaacggtttaacggtaacgggtaaaccgttaaaccccggttaccgggaaacccggaaaacggggttaaccaaaccggttacggttaaggggtaaaacggttaaacggttaaaagggtacgttaggttacgggtaacttaacggtaaccc

SEQ ID NO: 390730 - DNA, 562 bp, Homo sapiens
  misc_feature: GZ8MTXP01AOBLN.13.34.D01.1.454.CMB.2.raw
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaaccctctcctgcagggccagtcagagtgttagcagcagcttagcctggaccagcagagcctggccaggcctcccaggcctcctctatttagnggtgcatcccgacgttacgggccacgttcggtccgtccccagtcgagggttcaagggcgggctagggtcggggtctggggacaggtccttcgactctcaccatcagcacgcctgctgtctagtaatagttttgctagtcttattactgtacagtctagtattagttctgggacgttaccgttcgggaccgaacggggacacggacgttagggaacgtaagttaaacggacgtggttcggtcgttggaacc

SEQ ID NO: 390731 - DNA, 604 bp, Homo sapiens
  misc_feature: GZ8MTXP01CSW20.13.34.D01.1.454.CMB.2.raw
  modified_base (293)..(293): a, c, t, g, unknown or other
  modified_base (308)..(308): a, c, t, g, unknown or other
  modified_base (483)..(483): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgtagcagcagcttagcctggaccagcagaagcctggccaggctcccnggctccgtcatttancggtgacatcccagtacgggccctaacgtggtcccgtaccccgagtcgaagggttccaagggtccgggcgtagggttggggtacctagggggaaccagggttaccttcgactctaccaccatcagcagcctgctagtcgtagtaaagtagttttcgacgtagttacctattaccngttcaaggtctaagttatacgttagtgggtaacgttaccgttcgggaccgtaaacggggacacggttcgttaggggtaagtaaagttaaacggaacggtggttacgggtcttcggtaaccc

SEQ ID NO: 390732 - DNA, 584 bp, Homo sapiens
  misc_feature: GZ8MTXP01BOG6L.13.34.D01.1.454.CMB.2.raw
  modified_base (321)..(321): a, c, t, g, unknown or other
  modified_base (435)..(435): a, c, t, g, unknown or other
  modified_base (440)..(440): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtctccagtcaccctgtctgtgtctccgagggaatagccaacctctcctgcgagggccagtcagagtgtagcagcagtcttagcctggaccagcagagccgtggccaggccctcccgaggtcctcctactatttagtcggtncctactccgacgttacgggcctacgttcgggtcccgtccccaggtcgtaacgggttcaagggccgggcgtagggtcggggtctacggggacagtaccttcactctaccactacncagcncgtctgactagtctagtagttgttagcgtattacttattcgtgtacgtatacgtagttattacgttagtaacgtaacgttaccgtacggacgaaacggacacggttagttaggaagtaagtaaggtcgtggttacgtcgttcgc

SEQ ID NO: 390733 - DNA, 679 bp, Homo sapiens
  misc_feature: GZ8MTXP01DWEF7.13.34.D01.1.454.CMB.2.raw
  modified_base (329)..(329): a, c, t, g, unknown or other
tcagtcacgtactacacgaccggtgctcgatttagatcgtctgtgttgggtttggggagagctctgggggaggaactgctcagttaggacccagacggaaccatggaagccccagcgcagcttctcttcctcctgctactctggctcccagatactactggagaaatagtgctgacgcagtctcagtcaccctgtctgtgtctccgagggaaatagcaaccctctcctgcgagggccagtcagtagtgttagcagcagctagcctggaccagcagaacgccgtggccaggcctacccgaggtcctccgtactagtttagtcgggttacnctaactcccgtacgttacggggaccctacggttcggtacccgtccccgaggttccgtaacgggttccgaaacgggcccgggtgtaacgggttcgggggtcctagggggaacctacgggtaccttaccacttcctaccaccctataccgagccgacgtcctgaccgtagtcgtaagtaagttacgttttggacttacgttaccttaagttaccgtggtactacggtactaaggttattaacggttagttaacggaacgttaacccgttcggaaccgtaaagggtaccacggttacgttaggtaacggtaaagttaaacggtacggtaggttaccggtaacgttggtaaccc

SEQ ID NO: 390734 - DNA, 733 bp, Homo sapiens
  misc_feature: GZ8MTXP01C1AA6.13.34.D01.1.454.CMB.2.raw
  modified_base (318)..(318): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaaccctctcctgcgagggccagtcagagtgttagcagcagtcttagctggaccagcagaagcctggccaggcctacccgaggtcctcctctattttagngggtcgactactccgaacggttacggggccctacggttcgggttaccgtcccccgtaaggtccgtaacggggttccaaacggggtccgggcgtagggggttccgggggtacgttagggggaaccacggttaccttcctaccttcctaccaacctacgtaccgaacggacacggtcctacggcctaggttacttagtaaacgtttaggttttacggacgtttaacggttacgtttaattaccgttgggtactacggtacgttaaaggttagttaacggtttacggtaacgggttaaccggttaacccggtttaccgggaaaccggttaaacgggggacttaaacccgggttacggttaagggtaaacgtaaaggttaaaagggtacggttaggttacggggtaacttcgtaacccg

SEQ ID NO: 390735 - DNA, 731 bp, Homo sapiens
  misc_feature: GZ8MTXP01EXNAM.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaacctctcctgcagggccagtcagagtgtagcagcagcttagcctggaccagcagaacgcctggccaggctccccagggtcctcccgtatagttttacgtgggtcgctacgtcccgaacgtacgggggccctaacggttcgggtcccgttaccccgagtcccgtaaggggtttccgaaaggcccgggcgtaaggggttcgggggtcgttacgggggaacctacggtacctttacacccttctaccgtaacctactccacgaccacgtccgttacggacctagtactaggtaagttaggttttacgacgttacgttacgttaaactttacgttacggtactaacgtacgttaagttaaacgttaacggtttaacggtaacgggttaaacggttaaacccgggtttaaccggggaaccggtaaacgggggaacttaaccgggttaacggttagggtaaaggtaaagtttaaaacggggtaaccgttagggttacgggtaacgttcggtaacccg

SEQ ID NO: 390736 - DNA, 619 bp, Homo sapiens
  misc_feature: GZ8MTXP01BFYKH.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaaccctctcctgcagggccagtcagagtgttagcagcagcttagcctaggaccagcagaacgccgtggccaggcctccccgaggtcctcctctatttagtggtgccatcccgacgtacgggccctacgtcggtcccgtccccgtagtccgtagggttccaacgggccgggtcgaggggttcgggggtcgtacgggggaactacggtacctttcctacttcctaccacctaatccaagccgacggcctcggactagtctagtaagttagttttcgacttagttacttattacgtgtacagtctagttatagttacgtaaggtaacgttaccggttacggacgaaacgggacacggttagttaggaagtaagtaaggtaacgtgttacggtcgttcgtaacc

SEQ ID NO: 390737 - DNA, 654 bp, Homo sapiens
  misc_feature: GZ8MTXP01C97C4.13.34.D01.1.454.CMB.2.raw
  modified_base (302)..(302): a, c, t, g, unknown or other
  modified_base (598)..(598): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcacctgtctgtgtctccgaaggggaaatgcaaccctctcctgcaggccagtcagagtgtagcagcagcttagcctggaccagcaagaacgcctggccaggcctccgaggctcctntatttagcggtgactactccacgtacgggcctacgttcggtcccgtacccagtcgtacggttcaaacgggtccgggcgtagggttcggggtacgtagggggaacctacgggtaccttaccgactcctaccaaccgtatccgaacggctacggtccctaggacctaagtctagtaagtttagtttacgattacgttactttaattaccgtgttaccaaggtcttaaagtaagtttacggttacgtaacgggtaaccgttaaaccgttccgggaacggtaaaacgggacttaaccggngttaaagggtaagtaaagtttaaaacgggactgggttacggtcttaacggtaaccc

SEQ ID NO: 390738 - DNA, 676 bp, Homo sapiens
  misc_feature: GZ8MTXP01AVZMV.13.34.D01.1.454.CMB.2.raw
  modified_base (299)..(299): a, c, t, g, unknown or other
  modified_base (305)..(305): a, c, t, g, unknown or other
  modified_base (309)..(309): a, c, t, g, unknown or other
  modified_base (379)..(379): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagccaacctctctgcagggccagtcagagtgttagcagcagcttagcctggaccagcagagccgtggccaggctccaggctcctnatttanggtncatccacgtacgggccagtcggtctccccagtcgaggttcaaacggcgcgaggtcggggtactggggacncggtacttacgacgttctaccaccgattccgagtccgagtcccttagccgtagtccgtagtaaacgttacgtttttcgggaccttaacggtttaccttaaacgtttacctcggtttaacccgaaggttacccgttaaaggtttaacgttaacgggtttaacccgtaagggtaaacccgttaaacccggtttacccgggaaccgttaaacgggggaaccttaacccggggttacgttacggggtaaagtaacggtttaaaacgggaaccgtttagggacggtaacgttcgtaaccccg

SEQ ID NO: 390739 - DNA, 559 bp, Homo sapiens
  misc_feature: GZ8MTXP01B310S.13.34.D01.1.454.CMB.2.raw
  modified_base (315)..(315): a, c, t, g, unknown or other
  modified_base (319)..(319): a, c, t, g, unknown or other
  modified_base (518)..(518): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcacctgtctgtgtctccgaaggggaaatagccaaccctctcctgcagggccagtcagagtgtagcagcagcttagcctggaccagcagaacgccgtggccaggcctacccgaggcctctctatttagnggtncatccagtacggccagtggtcctccagtcgaggtcaaggcgcgtagggtgggtcgtagggacaggtactcactctacacatcagcagcctgcagtctagtacgttatttcgataagttcttaattcgtcgtactaaggctaagttagttagttaacgaaggtaaacgttaccggttcggaaccgaaagggtaccacggngttaggaagtaacgtaaagacggtgttacggtcttcgaacc

SEQ ID NO: 390740 - DNA, 592 bp, Homo sapiens
  misc_feature: GZ8MTXP01B1SWD.13.34.D01.1.454.CMB.2.raw
  modified_base (313)..(313): a, c, t, g, unknown or other
  modified_base (339)..(339): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagcaacctctcctgcgagggccagtcagtagtgtagcagcagcttagcctggacagcagaacgcctggccaggcctccgagcctctctatttagtggtncgatccacgtacggccacgtggtccnccctagtcgaggttcaaggcgggcgtagggtcggggtctaggggaactacggtaccttacacctctaccacatcagtcacgtcctgctagtctagtaacgttgtttcgacgttagtacttattctggtacagtctagttacttacggttacgtaaggtaacgttaacccgttcgggaaccgaaacggggtacacggttacggttagggtaaacgtaagtaaacgggtacgtgggttacgtcgttcggtaaccc

SEQ ID NO: 390741 - DNA, 622 bp, Homo sapiens
  misc_feature: GZ8MTXP01D2PE8.13.34.D01.1.454.CMB.2.raw
  modified_base (315)..(315): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgagggaatagcaacctctcctgcaggccagtcagagtgtagcagcagcttagcctggaccagcagaagcctggccaggcctacccgaggtcctcctctatttagtgggtncctatccagtacgggccagtcgggtacctcccagtcgaggttcaacgcggcgagggtcgggtcgtcggggactacggtactttacacctcttaccaaccctataccgagaccgacggccttggaccgtagttcgtagtaaagttaggtttttcgacttaacgttcctttaattaccgtaggttccaaagtcgtagtaattacggttactaaggtaaccggttaaaccgttcgggaacccgaaaggggtaaccgacgcggttagggaagtaaaaggtttaaggaacgtgttacgggtccttcgaaccg

SEQ ID NO: 390742 - DNA, 641 bp, Homo sapiens
  misc_feature: GZ8MTXP01DMXQE.13.34.D01.1.454.CMB.2.raw
  modified_base (308)..(308): a, c, t, g, unknown or other
  modified_base (311)..(311): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctctagtccaccctgtctgtgtctccgaagggaatgaccaaccctctcctgcgacgggccagtcagtagtgttagcagcagcttagcctggaccagcagacgctggccagctccagtctctctatttngtncatccacgtacggccagtcggtcctccgtagtcgacggttcgaacggcggtcgtaggtcggggtacgtaggggaccgtacggtaccttccaccttcctacaaccctatccgacgcacgtcctgaccagttcgtagtaacgtttgtttacggacttagttaccgtttatttacccgtgtacgttaacgagttaagttaccgtttaagttacggtaagggttaaccttaaacccgggttacggaccgtaaaaggggcccttaagggttacggttaacggtaagttaaaacgttaaacgggtacgtacggttacgggtcttaacggtaacccg

SEQ ID NO: 390743 - DNA, 676 bp, Homo sapiens
  misc_feature: GZ8MTXP01EJY0H.13.34.D01.1.454.CMB.2.raw
  modified_base (219)..(219): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctcggggccccagggcagagggtcaccatctcctgcactggancagctccaacagttggggcactattatgatgtacactggtaccagctaagtttccgaggagcaggtccccagactcctcatacaatagtaacaacaacgtccggcccgacgacggggtccctcgaccgtattctctcggtctcccgggtcgcgggccacctccacgtccctcccgttggtctactccgtacgtcggcctccgacggtcgtaggacggtagtcggaggtcctaggttacttttaacgttttccgttccggtacctaacgttaccccgttaagttcgaaaccgtacgccgacggttccgtgggtaacggtttcgttaaccggttttcggggttaaccggtttcggggggtccccggggggttaacccgttcgggttcccgttaaccgggtacccggttaacccggtttacggggaccgttaaccggtccccggttaacgggtcccccgg

SEQ ID NO: 390744 - DNA, 624 bp, Homo sapiens
  misc_feature: GZ8MTXP01AR3G1.13.34.D01.1.454.CMB.2.raw
  modified_base (249)..(249): a, c, t, g, unknown or other
  modified_base (376)..(376): a, c, t, g, unknown or other
  modified_base (429)..(429): a, c, t, g, unknown or other
tcagtcacgtactacacgaccggtgctcgatttagatcgtctgtgttgggtttgggggagagctctgggggaggaactgctcagttaggacccagacggaaccatggaagccccagcgcagcttctcttcctcctgctactctggcctcccagatactactggagaaatagtgctgacgcagtctccagtccacctgtctgtgtctccgaaggggaatacgccaaccctctcctgcagggccagtcagngtgtagcagcagtcttagctggacagcagacgctggccaggcctcccgaggcctctactatttagtggtcgcactccacgtacgggcccagtcggtcccgtcccagtccgtaggtacaagggccggngtagggtcggggtcgtaggggactaggtccttactacctctaccacatcgacnccgacgtctacgcgtacgtcgtagtaagttacgtttcgtacgttacgttactttacttacgtcgtacgtacgtacgttagtttaacgttaacgttacggtaacggtaaccgttaccggtaccggaaccggtaaacggtaacttacggagttaacggaagtaaacggtaacggtacgtaggcgtcgttaacgaacg

SEQ ID NO: 390745 - DNA, 687 bp, Homo sapiens
  misc_feature: GZ8MTXP01DUFMZ.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaaatagcaaccctctcctgcaggccagtcagagtgttagcagcagcttagcctggaccagcagaacgcctggccagcctacccgaggcctcctctatttagtggtgcactccgacgttacgggccctacgtcggtcctccccgtagtccgtaaggtttccgaaagggtcccgggtcgaggggttcgggggttacccgtacgggggtaaacctacgggtaacccttttcccgtaacctttacccgttaccaaaccccgtacttaccgaaacgtaccgacggtcccgtggaccacgttaccgtaggtaaacggttatttttcgacgttagttacttaacttaccgttgtaccgtagtcgtaagttagttaaggtttacgtaaggtaacgttaaccgttccggaacgaaacgggtcgaaacggttgttaagggtaagtaaaggttaaacggaaccgttggttacggtcttaacggtaaccc

SEQ ID NO: 390746 - DNA, 719 bp, Homo sapiens
  misc_feature: GZ8MTXP01EQRW5.13.34.D01.1.454.CMB.2.raw
  modified_base (225)..(225): a, c, t, g, unknown or other
tcagtcacgtactacacgaccggtgctcgatttagatcgtctgtgttgggtttgggggagagctctgggggaggaactgctcagttaggacccagacggaaccatggaagccccagcgcagcttctcttcctcctgctactctggctcccagatactactggaagaaatagtgctgacgcagtctcagtcaccctgtctgtgtctcgaggggaaatagcaacctntcctgcgagggccagtcagagtgttagcagcagtcttagcctaggaaccagcaagaacgccgtggccaggcctacccgagtcctccgtactagttttaagtcgggtacacctaactcccgaaggttaaccggggccctaaacggttcgggtccgttacccccgtaaggttacccgtacgggtttaccggaaacgggtccgggtaacgtaacgggggtttcgggggtaccgttacgggggaacctacgggttaccctttaccgaacccgttcctacccgaaacctacttccgaaacggccacgtacccgttggacccttaagttcgtaagtaaagttctttttcggactagtttaacccttaaagttccgtggttaccaagtcctaaaggttaagtacgtttacgaacgggtaacgttaaccgttcgggaaaccggaaaggtcccaaggttacttaggggaataaagtaaagcgtggttaggtaacttcggaacc

SEQ ID NO: 390747 - DNA, 657 bp, Homo sapiens
  misc_feature: GZ8MTXP01CCCWK.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaaccctctcctgcgagggccagtcagagtgttagcagcagtcttacgccgtcggaccagcaagaacgccgtcggcccgaggcctccccgaggtcccttcccgtactagttttagtggtcgactactcccgaacgtacgggcctacgtcgggtccgtccccgagtcgtaggtcaacgggcggcgtagggtcggggtcgtcggggacacggtaccttcgaccttcctaccacactcgaacgccgtacgcctggcctagttctagtaaacgtttggttttgaccttaacgttcttaagtttaccgtggtccgtaagtactaaggtttaacgttacgttaacggaacgggtaaccgttaccggtttaccgggacggaaacgggtcaaccggttagttagggaaagttaagttaaacggagtcggttacgggtcttgtaaccc

SEQ ID NO: 390748 - DNA, 715 bp, Homo sapiens
  misc_feature: GZ8MTXP01D1QN2.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcgagggaatagcaaccctctcctgcagggccagtcagagtgttagcagcagcttagcctaggaccagcagaacgcgtcggccaggcctcccgaggtcctcctctatttagtggtgactactccgacgtacgggccctacgttcggtccgtccccgagtcgtagggtttccaacgggccggcgtagggtcggggtcgtacggggaactacggtacctttccaaccttcctaccaaccctagttaccgacgaccctacgtcccgtagccgtaagttccgtaaggtaaacgtttacgggttttcgtaacgttaacggtttactttaacttaccgttgtaccgtaagttaccgtaaggtttaacgttaacggtttaccgtaacggggtaaacgttacccggtttaccggggaaacccggtaaacggggtaacccaaacgggttaacggttacggggtaaaaggttaaacggtttaaaagggaaccgttgggacggtaaccgttaacggtaaccccg

SEQ ID NO: 390749 - DNA, 720 bp, Homo sapiens
  misc_feature: GZ8MTXP01B1ZI5.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccacctgtctgtgtctccgaggggaaatgccaaccctctcctgcagggccagtcagagtgtagcagcagcttagcctaggaccagcagacgccgtcggccaggccaccgaggtccctaccttactaagtttagtcgggtacactactcccgaacggtacgggaccctacggttcgggtaccccgtcccccgtaaggttcccgtaacgggtttccgaaacggggtccgggtcggtaaggggtttcgggggtaccgtacgggggtacctaacgggttacccttacctaccctttcgtacccaacacgtaccacggacgacgtccgtacgacgtacgttacgttaaggttaagtttacggttttcggactttacgttactttaacgttaccgtgtaccgagtactaaggttattaacggttacgtaagggtaaccgttaacccggtacgggaaccggtaaagggaccttaacgggttacggttaagggttaaagaaaggtttaaaacggcgtagggttacgtccgttaagaacccg

SEQ ID NO: 390750 - DNA, 618 bp, Homo sapiens
  misc_feature: GZ8MTXP01CLGQ4.13.34.D01.1.454.CMB.2.raw
  modified_base (293)..(293): a, c, t, g, unknown or other
  modified_base (306)..(306): a, c, t, g, unknown or other
  modified_base (435)..(435): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcacctgtctgtgtaactccgaaggggaaatagcaaccctctcctgcagggccagtcagagtgttagcagcagcttagcctggaccagcagaagcctggccaggccncccgaggcctccnctatttagtggtgcatccagtacgggccacgtggtccgtcccaggtcagggttccgaaacggcgggtcgagggttcggggtcgtacggggactaggtacctcgtacctctaccacatccagccacgccngacgacgtctagtaaacgttagtttttcgacgttagttaccttaacttacgtgttaccgagtacctaaggttacttaaggttacgtaagggtaaacgttaccggttaccggaccgtaaacgggacgacgagttagggaaagtaagttaaacgggacgttgggttacggtaacgttcgtaaccg

SEQ ID NO: 390751 - DNA, 676 bp, Homo sapiens
  misc_feature: GZ8MTXP01CA8KW.13.34.D01.1.454.CMB.2.raw
  modified_base (251)..(251): a, c, t, g, unknown or other
tcagtcacgtactacacgaccggtgctcgatttagatcgtctgtgttgggtttgggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttancagcagcttagcctggtacccagcagaacgccgtggccaggctcccaggcctcctcatttatggtcgcattccacgtagggccacgtggtccgtcccgagtcgtaggttcaaacggccgggcgtagggttcggggtcgttcgggggaacacgggtactttccacttcctacccaacctatccgaacgaccgtacggccttgggctaagttccgtagtaaacggttagtttttcggaccttaggtttaccttaatttaccgttaggttactaacgtccgtaagggttaactttaacggtttaacgtaagggtaacggttaaccccgtttacggggacccgtaaacgggggaccgttaaccggttacgttacggggtaagtaacgttaaaacgggaacttcggttacgggtaacgttcggtaacccg

SEQ ID NO: 390752 - DNA, 641 bp, Homo sapiens
  misc_feature: GZ8MTXP01ETS5L.13.34.D01.1.454.CMB.2.raw
  modified_base (258)..(258): a, c, t, g, unknown or other
  modified_base (331)..(331): a, c, t, g, unknown or other
  modified_base (474)..(474): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggcctcccagatactactggaagaaatagtgctgacgcagtcctccagtccaccctgtctgtgtctccgaagggaaatacgccaaccctctcctgcgacggccagtcagagttgtancagcagtcttagcgtggaccagcagaacgcgtcggccacgcctccgacggtccttccgtatatttagtcgggnaccctactaccgacgtacgggcctacgttcggtaccccgtcccgtaagtcgtcgggtaccgaagggcccgggtgtaacggggttcggggtacgtacgggaactaacgttctaccacttcaccctacatcggagtccgagtccnggactagtgaaagttagtacggtttagacttacgttacttactgtcgtacagtactaagttaacgtacgtaacggtaacggtaacgttaccgggacgaaacggtaacgtaacgaacgttaggaggtaaacgttaaagtaaccggtagtcggttagtccgttcgaacc

SEQ ID NO: 390753 - DNA, 721 bp, Homo sapiens
  misc_feature: GZ8MTXP01D6GAQ.13.34.D01.1.454.CMB.2.raw
  modified_base (354)..(354): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtccgtcggggccccagggcaggagggtcaccatctcctgcacgtgggagcacgctaccaacgtagttggggcaactattatggattgtacacgtggtaccagtctacgtttccgaggacgcgacggtacccagtacctctacatacaaataagtaaaccaaactacgtccggaccccgngaccgggggtccctacgacctacgttctcgtcggacccttccgaagggtctacgggtccaccccgttcgaccgtccccttcccgtacggtctactccgtacgtcggccttcccggaggtccgtagggaggtacgtgggtacggttaccgttaggggttaactttttagtttccgttacggacccgttacgttacccttagttaccgacgacgtccgtaacgtcccggtaaggtcgttcgggttccgtttacgggttacgggggtttaccggggggacccgggggaacccggttaggttcccggtaccgggttaaccccggtttcggtaccgggttacccgaacccgggttaaccggtaaccccgggg

SEQ ID NO: 390754 - DNA, 571 bp, Homo sapiens
  misc_feature: GZ8MTXP01BCM9A.13.34.D01.1.454.CMB.2.raw
  modified_base (306)..(306): a, c, t, g, unknown or other
  modified_base (312)..(312): a, c, t, g, unknown or other
  modified_base (316)..(316): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggaccagcagtaagcctaggccaggctcccgaggcctcctnatttanggtncatcccagtacgggcctagtgggtcctacccagtcagggttcacggcgcgagggtggtcgtaggacacgtctacactcacgacatcgacgacgacgctcgacgtacgtacgtagtagttagttacgtacgtacgttacgttacgttacgtacgtacgtacgtacgtagtagttacgtacgtaacggtaacgttaccgtacggacgtaacggacgacgacgttaggtaagtaagtaagtagtagttcgtcgcgtcg

SEQ ID NO: 390755 - DNA, 724 bp, Homo sapiens
  misc_feature: GZ8MTXP01C53EC.13.34.D01.1.454.CMB.2.raw
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggagcagctaccaactagttggggcactattatgatgtacacgtggtaccagctagtttccgaggacgcacggtccccagtacctcctacattacaaataacgtaaaccaacaacgtccggacccgacgacggggtcccctacggaccgtattccgtcgtcggaccctaccgcgggtccgtcgggaccctaccccgtcgaaccgtcccccttaccccgttcggttacctacgttaccgtaacggtcggggtaccctaccggtacgggtaccgttaagggaacgggttaagtacggggtaacgggtacctttagggggtttaaacgtttttaacttttaccgtccggtacccgttaacggttaccctagttacggaacgtacgtaccgacgtcccgttggtacggttcggttaccggttacggggttacgggttccgggggacccgggggttccacgggtcgtacggtaacccgttcgtacggttaccgaaccggttcccgtaaccggg

SEQ ID NO: 390756 - DNA, 786 bp, Homo sapiens
  misc_feature: GZ8MTXP01AZLXK.13.34.D01.1.454.CMB.2.raw
  modified_base (298)..(298): a, c, t, g, unknown or other
  modified_base (382)..(382): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatgtgctgacgcagtctcagtcaccctgtctgtgtctccgaaggggaaatcgcaaccctctcctgcagggccagtcagtgtgtagcagcagctagctggacagcagacgcgtggcagcctccgaggtcctcgtntatttagtggtcgctacgtccacgtacgggtccctacggtggtccccgtcccgtaggtccgtaggggttaccaagggcccgggngtaggggttcggggtacgtacggggtaactacggtactttccaaccttctaccgaacctataccgacgaccgtacgtccgtcggtacgtacggttctaagggttaaaccgtttgggtttttacggacccgtttaaacggtttacctttaacgtttaaacccgttcggttaacccgtaaagggttaaccgttaaagggttttaaacccgtttaaaggggttttaaccggtaaacggggttaaaccccggttaaacccggggttttcccccggggaaaaccgggtaaaacgggggaacccttaaaacccggggttaacgggttaaggggtaaaaacgggtttaaaacggttaaaaaccgggggttaaggttcgggttaccggggtaaccttaaccgttaaccccgg

SEQ ID NO: 390757 - DNA, 654 bp, Homo sapiens
  misc_feature: GZ8MTXP01BJOZX.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcgaggggaatagcaacctctctgcagggcagtcagagtgttagcagcagctagctgacagcagacgcgtgccagcctccgagctcctctatttacgtggtcgactatccgtacgtacgggacctacgtcgggtcccgttaccccgaggtttaccgagggtttaccgaaacgggtcccgggcgttaacggggtcgggggttacgtacgggggtaactacgggtacctttactaccttctaccaacgtactacgacgaccgacgtccgtcgacacgtacgtagtaagttattttacgacgttagtactttaattaccgtgttacgaacgtacttaaggtacttaggttacgtaacgggaacgttacccggttaccggaaccggtaaagggtaccttaacggcgttaagggaaacgtaaagttaaacggaggtcggttacgtcgttcgaacccg

SEQ ID NO: 390758 - DNA, 802 bp, Homo sapiens
  misc_feature: GZ8MTXP01D1W1D.13.34.D01.1.454.CMB.2.raw
  modified_base (331)..(331): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctaccgagggaaatagcaaccctctccgtgcagggccagtcagtagtgtagcagcagtcttagcctaggaccagcagaacgcgtggccaggccctacccgaggtccttccgtactagtttagtgggtacncctacgtacccgacgttaaccggggcctaacgttcgggtcccgtaccccgtaggtaccgtacggggttccaaacggggccggtaacggtaggggttcggggtaccgtacgggggtaactacgggttaccgtttacccaaccttcctacccgtaaccgtactacccgacggtaacccgtacggtccccgtagtaccggtaaacgttccgttaaagggtaaaaccgttttcggtttttaccggaccgtttaacggtttacctttaaacgtttcccgttacggttaacgtaaacggttaccgttaaaggtttaacgttaacgggttttaaccgaaacggggttaaaccccgttaacccggggtttacccgggaaaccggttaaaacgggggacccttaaaccgggttcggttaaggggtaaacgttaaaacgggttaaacgggtacgtcgggttacgtaacgttcgggtaaccc

SEQ ID NO: 390759 - DNA, 647 bp, Homo sapiens
  misc_feature: GZ8MTXP01AI03Q.13.34.D01.1.454.CMB.2.raw
  modified_base (271)..(271): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagccaaccctctcctgcgagggccagtcagagtgtagcagcagtctagctggaccngcagagccgtggcctaggcctcccgaggtccctcctactagtttacgtggtcgctactacccgacgttacgggccctacgttcggtcccgtcccgagtcgtaggttcaacgggtcgggtcgtagggtcggggtacgtcggggacctagggtacctttacgaccttcgtaccgacctactacgacgccgacgccgtgaccgtagtcgtagtaaagttcggtttgaccgttagttaccttatttaccgtgtaccgtagtctaagttagtacgttaggtaaggtaacgaaccgttcggaccgtaaagggaccttacggttacggttaaggtaaacggtaaagttaaacgggtacgtgggttccgtaacgttcgtaaccg

SEQ ID NO: 390760 - DNA, 519 bp, Homo sapiens
  misc_feature: GZ8MTXP01C9FKY.13.34.D01.1.454.CMB.2.raw
  modified_base (297)..(297): a, c, t, g, unknown or other
  modified_base (305)..(305): a, c, t, g, unknown or other
  modified_base (349)..(349): a, c, t, g, unknown or other
  modified_base (423)..(423): a, c, t, g, unknown or other
  modified_base (426)..(426): a, c, t, g, unknown or other
  modified_base (432)..(432): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatagcaaccctctcctgcagggccagtcagagtgttaagcagcagcttagctgaccagcagaagctgccaggctccgagctcnctatttanggtgcatccataggccagtggtcgtcccagtcaggttcaacggngcaggtgggtctggggacagactcactctcacatcagcagcctgcagtctagaagtagtttgcagtctattacngtnaacgtntagtatagtagtggaacgttaccgtcggacgaagggacacgagttaggaaagtaaagttaaggtacgtggttacggtcgttgtaacc

SEQ ID NO: 390761 - DNA, 565 bp, Homo sapiens
  misc_feature: GZ8MTXP01ACUX6.13.34.D01.1.454.CMB.2.raw
  modified_base (202)..(202): a, c, t, g, unknown or other
  modified_base (256)..(256): a, c, t, g, unknown or other
  modified_base (259)..(259): a, c, t, g, unknown or other
  modified_base (280)..(280): a, c, t, g, unknown or other
  modified_base (298)..(298): a, c, t, g, unknown or other
  modified_base (301)..(301): a, c, t, g, unknown or other
  modified_base (309)..(309): a, c, t, g, unknown or other
  modified_base (421)..(421): a, c, t, g, unknown or other
  modified_base (444)..(444): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtcctccagtcaccctgtctgtntctccgaaggggaaatgccaaccctctcctgcaggggccagtcagtagtgtagnagnagcttagcctggacagcagancctggccaggctccagcnctntatttagnggtgcactccgacgtagggcctagtcggtcctccctaggtctaagggtcaaaggccggtcgtagggtcggggtgtcggggactaagcttacgactctacactactcagcacncctgctagtctagagtagtttcngtagtacttaatcgtgtactactatacgttattagttacgaaggtacgttaaccggtcgaccgaggaacacggttacgttaggaacgtaagtaaacggtacgtggttacgtcgttcgaacc

SEQ ID NO: 390762 - DNA, 522 bp, Homo sapiens
  misc_feature: GZ8MTXP01ANIQW.13.34.D01.1.454.CMB.2.raw
  modified_base (219)..(219): a, c, t, g, unknown or other
  modified_base (264)..(264): a, c, t, g, unknown or other
  modified_base (288)..(288): a, c, t, g, unknown or other
  modified_base (298)..(298): a, c, t, g, unknown or other
  modified_base (325)..(325): a, c, t, g, unknown or other
  modified_base (378)..(378): a, c, t, g, unknown or other
  modified_base (384)..(385): a, c, t, g, unknown or other
  modified_base (390)..(390): a, c, t, g, unknown or other
  modified_base (394)..(394): a, c, t, g, unknown or other
  modified_base (398)..(398): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctccagatactactggagaaatagtgctgacgcagtctcagtcaccctgtctgtgtctccagggaatagcaacctntcctgcagggccagtcagtgtgttagcagcagcttagctggaccngcagagctggccagctccagctcntattatcggncacgtccactacgggccagtcggtacnccgagtcaggttcaagggcgctaaggtcgggctagggacagtacttcacttcncactannagacncgcncgcngtagtagtagtagttcgtctactactactctcgtcgagacgtaccccctatacgtagtaagacgttacgtacgacgacgacgacgcgttagaagtaagtaacgtacgtaggttagtcgttcgtc

SEQ ID NO: 390763 - DNA, 644 bp, Homo sapiens
  misc_feature: GZ8MTXP01BRNII.13.34.D01.1.454.CMB.2.raw
  modified_base (574)..(574): a, c, t, g, unknown or other
  modified_base (588)..(588): a, c, t, g, unknown or other
  modified_base (616)..(616): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccaccctgtctgtgtctcgaggggaatagcaacctctcctgcagggccagtcagtagtgtagcagcagtcttacgctggaccagacagacgccgtcggacccgacggcccccaggtccctccctactactccgtaacgtattcgttacgtttaccggaagggggtaccgtaaccctacgttcgaaccctaactcccccgaaaggaccgtacgggtttacgaacgggtacggcggtaagggttcggggtaccgtacggggactacggtactttccgactcgtaccaccgatcacgacacgtacgtacgggaaacctgggaacttactttcgactttacgttttacttcgtacgtaccaaccgttagttacgacggttactggggtacncttcgaactacttntccgttatcgttcacttcccttccgctnttccgttggattcggtaacgttcgaagg

SEQ ID NO: 390764 - DNA, 708 bp, Homo sapiens
  misc_feature: GZ8MTXP01AI72H.13.34.D01.1.454.CMB.2.raw
  modified_base (360)..(360): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaatagtgctgacgcagtctccagtcaccctgtctgtgtctccaggggaatagcaacctctcctgcagggccagtcagagtgttagcagcagcttagcctggtaccagcagagcctggccaggctccccgaggtcctccgttcatttagtggttgacagttccccacgtaggggccctacgttcgggtccgtaccccgngtcgtaacggttccgaaagggccggtccgaagggttcggggtacctagggggacctacggtaaccttccgaaccttccttaccgaccctaacttacgaacgtccgaacgtcccgtcggtacccgaggttaccgttacggtaaacggttaaccggttttttggacctttacgggttaccgtttaacgtttacccttagggttacctaacggtacctaacgttaacgttaaggtttaaccgttaacgggtaaacggttaaccctttacggggacccgaaacggggtaaccgaacggttacgttacgggtaaggtacgttaaaaggacgttagttacgggcttcggtaacc

SEQ ID NO: 390765 - DNA, 495 bp, Homo sapiens
  misc_feature: GZ8MTXP02FON68.13.34.D01.1.454.CMB.2.raw
  modified_base (390)..(390): a, c, t, g, unknown or other
  modified_base (393)..(393): a, c, t, g, unknown or other
  modified_base (395)..(395): a, c, t, g, unknown or other
  modified_base (401)..(401): a, c, t, g, unknown or other
  modified_base (410)..(411): a, c, t, g, unknown or other
  modified_base (420)..(420): a, c, t, g, unknown or other
  modified_base (422)..(422): a, c, t, g, unknown or other
  modified_base (424)..(425): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtggggtctggggacagacttcactctcaccatcancancngcagtntagagattnnatatatatntnannatatatatagagactacgacgaacggacgacgacgagaagaagtaaaagtaaacgtagtagacgtcgacg

SEQ ID NO: 390766 - DNA, 535 bp, Homo sapiens
  misc_feature: GZ8MTXP02IV0JG.13.34.D01.1.454.CMB.2.raw
  modified_base (308)..(308): a, c, t, g, unknown or other
  modified_base (409)..(409): a, c, t, g, unknown or other
tcagtcacgtactacacgaccggtgctcgatttagatcgtctgtgttgggtttgggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttanggtgcatccactagggccactggtcgtcccagtcaggttcagcgcagtgggctggggacagacttcactctcaccatcagcacgcctgcagtctagaagtntttagcagtctattactgtcagcagtatagttactggacgtaaccgttcggaccgaaagggccaacggtaccgtagggaagtaaacgttaaaacggggaaactggttacggaccgttacggaaccc

SEQ ID NO: 390767 - DNA, 515 bp, Homo sapiens
  misc_feature: GZ8MTXP02IIAW9.13.34.D01.1.454.CMB.2.raw
  modified_base (309)..(309): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccagggctcctcatttanggtgcatccactagggccactggtcgtcccagtcaggttcagcgcgagtgggtctgggacagacttcactctcaccatcagcagcctgcagtctgaagtatttgctagtctattactgtcagcagttatagttactggagaccttcgggacctaaacgggacaacgactggaagaagttaaaacggactaggtacggactagaccg

SEQ ID NO: 390768 - DNA, 504 bp, Homo sapiens
  misc_feature: GZ8MTXP02J1UI4.13.34.D01.1.454.CMB.2.raw
  modified_base (308)..(308): a, c, t, g, unknown or other
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttanggtncatccactagggccacgtggtctcccagtcaggttcagcggcaggtgggtctggggacagtacttcactctcaccatcagcagcctgcagtctgaagtatttgctagtctattactgtacagcagtatagtactggagtaccttcggacaacggacacgactaggaagtaagtaaaggacgtgtaggctgac

SEQ ID NO: 390769 - DNA, 516 bp, Homo sapiens
  misc_feature: GZ8MTXP02H39M9.13.34.D01.1.454.CMB.2.raw
  modified_base (308)..(308): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttanggtgcatccactagggccactggtcgtcccagtcaggttcagcgcagtgggtctgggacagacttcactctcacatcagcagctgcagtctagaagtatttgctagtctattactgtcagcagtatagttactaggacgtaccttcggaccgaaagggaccaacgacgtaggaagtaagttaaaaggaacttggtacggcctaggacc

SEQ ID NO: 390770 - DNA, 530 bp, Homo sapiens
  misc_feature: GZ8MTXP02IDBF0.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggcctcctctatttagtggtgcatccactagggccacgtggtcgtcccagtcaggttcagcggcaggtggtcgtgggacagacttcacctctcaccatcagcacgcctgcagtctagaagtatttgctagttactattactgtcagcagttatagttacgtaggtacgtaccgttacggaccgaaacgggacacgacgaggaagtaagttaaaggacgtggtacggtctagacc

SEQ ID NO: 390771 - DNA, 519 bp, Homo sapiens
  misc_feature: GZ8MTXP02G1BMY.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggctcctcatttatggtgcatccactagggccacgtggtcgtcccagtcaggttcagcgcagtgggtctggggacaggacttcactctcaccatcagcagcctgccagtctagaagtatttgcagtctattactgtcagctagtatagttactggacgtaaccttcggaccaagggaccaacgactaggaagtaagttaaaaggactaggtacggactaggacc

SEQ ID NO: 390772 - DNA, 508 bp, Homo sapiens
  misc_feature: GZ8MTXP02H4POW.13.34.D01.1.454.CMB.2.raw
  modified_base (309)..(309): a, c, t, g, unknown or other
  modified_base (313)..(313): a, c, t, g, unknown or other
  modified_base (363)..(363): a, c, t, g, unknown or other
  modified_base (397)..(399): a, c, t, g, unknown or other
  modified_base (401)..(401): a, c, t, g, unknown or other
  modified_base (413)..(413): a, c, t, g, unknown or other
  modified_base (429)..(429): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggctcctcatttanggtncatccacgtagggccacgtgtcgtcccagtcaggttcagcgcagtggtcngggactagacttcactcacaccatcagcagtccnnntnagtagtattgtntatatatatgtacagntatatagtagtacgtacgtacgtacgacgaacggacgacgacgagaagtaagtaaacgtaacgtagtacgacgtacgcg

SEQ ID NO: 390773 - DNA, 523 bp, Homo sapiens
  misc_feature: GZ8MTXP02H8MRH.13.34.D01.1.454.CMB.2.raw
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggctaggctcccaggctcctcatttatggtncatccactaggggccacgtggtcgtcccagtcaggttcagcgcagtggctgggacagacttcactctcacatcagcagcctgcagtctagaagtattttgctagtctattactgtcagctagtatagttactggacgtaaccgttcggaccgaaaggggaccacggtaacgtagggaagtaagttaaaagggactaggtaggactaggacc

SEQ ID NO: 390774 - DNA, 520 bp, Homo sapiens
  misc_feature: GZ8MTXP02HP7HW.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatctacgatgtattcaggagaccatgaccatcccagacaggttcagtggcagtgggtctggggacagacttcactctcaccatcagcagactgggaacctgaaacgacttttgacttacttttatttctagttcaacctagttagtggtaacttggtggccttggctacctatcgttcgtcttctactccttcccgcattcctagtactagtacgtg

SEQ ID NO: 390775 - DNA, 512 bp, Homo sapiens
  misc_feature: GZ8MTXP02JNJAH.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggcctcctcatttatggtgcatccactagggccacgtggccgtcccagtcaggttcaggcgcaggtgggtctggggacagacttcactctcaccatcagcagcctgcagtctagagtatttgctagtctattactgtcagcagtatagtacgtggagtaccgttacggaccgaagggacacgacgtaggaagtacgtaaaggactagtggactagac

SEQ ID NO: 390776 - DNA, 531 bp, Homo sapiens
  misc_feature: GZ8MTXP02F0GL9.13.34.D01.1.454.CMB.2.raw
  modified_base (308)..(308): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttanggtgcatccactagggccactggtcgtcccagtcaggttcagcggcagtgggtctgggacaggacttcactctcaccatcagcacgctgcagtctagaagtatttgctagttctattactgtcagcagtatagttactaggtagtaaccgttcggaccgtaacgggaccgaacgacgttagggaagaagttaaaacggaacgttaggtaggtacgtaggaccg

SEQ ID NO: 390777 - DNA, 520 bp, Homo sapiens
  misc_feature: GZ8MTXP02JZ2Y3.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccagctcccaggctcctcatttatggtgcatccactacggggccacgtggtcgtcccagtcaggttcaggcggcaggtgggtctggggacaggtacttcactctcaccatcagcagcctgcagtctagaagtatttgctagtctattactgtcagctagtatagttactaggacgtaccgtcggaccaagggacacggacgtaggaagtaagtaaacggactggtacgacgtcgacc

SEQ ID NO: 390778 - DNA, 492 bp, Homo sapiens
  misc_feature: GZ8MTXP02G1468.13.34.D01.1.454.CMB.2.raw
  modified_base (438)..(438): a, c, t, g, unknown or other
  modified_base (447)..(447): a, c, t, g, unknown or other
  modified_base (456)..(456): a, c, t, g, unknown or other
  modified_base (460)..(460): a, c, t, g, unknown or other
  modified_base (472)..(472): a, c, t, g, unknown or other
  modified_base (474)..(474): a, c, t, g, unknown or other
  modified_base (478)..(478): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaaccctctcctgcagggccagtcagagtgttagcagcagcttagcctggtaccagcagagcctggccacggcccccaggcctcctcatctacgatgtattcgaggacgaccactgacactcccagacaggttcagtgctaggtgggtctgggacagacttcactctcaccatcagacagactacggaacctgaacgtactttgactactttattctgtcacngtatgatgngctgcactntctntctctctctccntntctnactacgtcgtagcg

SEQ ID NO: 390779 - DNA, 525 bp, Homo sapiens
  misc_feature: GZ8MTXP02GY05R.13.34.D01.1.454.CMB.2.raw
  modified_base (309)..(309): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttanggtgcatccacgtagggccagtggtcgtcccagtcaggttcagcggcagtgggtctggggacagacttcactctcaccatcagcacgcctgcagtctagaagtatttgactagttcttattactgtcagctagttatagttacgtaggacgtacttcggacgaaagggaccacgacgtaggaagtaagttaaaaggactaggtcggtcgtacgacc

SEQ ID NO: 390780 - DNA, 493 bp, Homo sapiens
  misc_feature: GZ8MTXP02HC153.13.34.D01.1.454.CMB.2.raw
  modified_base (349)..(349): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaaacaaacaatcggcccgcacggggtccctgaccgattctctggctcngtctggcacctcagcctccctgtcatcactggctcagctgagatgaggctgattattctgcagtccatgacagcagcctgagtgcttcggtacgttcgggcgggggacccaggccgtgacccgtcgtaaggtcacgccgaacgg

SEQ ID NO: 390781 - DNA, 524 bp, Homo sapiens
  misc_feature: GZ8MTXP02I5WU9.13.34.D01.1.454.CMB.2.raw
  modified_base (353)..(353): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagcttagcctggtaccagcagaagcctggccaggctcccaggctcctcatttatggtgcatccacgtagggccagtggtctcccagtcaggttcagcggnagtggggtctggggacagacttcactctcacatcagcacgcctgcagtctagaagtagttttcgctagttctattactgtcagtctagttactagttactaggtacgtaaccgttcggacgaacggtacacgacgtaggaagtagttaaaacggactggtacgctaggacc

SEQ ID NO: 390782 - DNA, 539 bp, Homo sapiens
  misc_feature: GZ8MTXP02HT2DL.13.34.D01.1.454.CMB.2.raw
  modified_base (409)..(409): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggcctcctcactttatggtgcatccactagggccactggtccgtccagtcaggttcagcgcaggtggctgggacagacttcactctcacatcagcagcctgcagtctagaagtnttttgctagttctattactgtcagctagtatagttacgtaggtacgtaaccgttcggaccgtaaagggacctacggtaacgtaggaaggtaagttaaaacgggtaacgtaggtacggtcgttaggacccg

SEQ ID NO: 390783 - DNA, 506 bp, Homo sapiens
  misc_feature: GZ8MTXP02HJ551.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttatggtgcatccactagggccagtggtcgtcccagtcaggttcagcggcagtggtctgggacagacttcactctcaccatcagcagcctgcacgtctagaagtattttgctagtctattactgtcagcagtatagttactggacgacttcgacaacggacacgacaggaagaagttaaacggactagtcggactagaccg

SEQ ID NO: 390784 - DNA, 516 bp, Homo sapiens
  misc_feature: GZ8MTXP02H3TOE.13.34.D01.1.454.CMB.2.raw
  modified_base (354)..(354): a, c, t, g, unknown or other
  modified_base (369)..(369): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagcttagcctggtaccagcagaagcctggccaggctccccaggctcctcatttatggtgcatccactagggccactggtgtccccagtcaggttcagcgcngtgggtctggggacngacttcactctcacatcagcacgcctgcagtctgtaagtattttgctagtctattactgtcagcagtatagttactggagtaaccttcggacctaacggacgacgtactgggaacgtagttaaaaggactaggtacggcgtacgacc

SEQ ID NO: 390785 - DNA, 576 bp, Homo sapiens
  misc_feature: GZ8MTXP02GU3YB.13.34.D01.1.454.CMB.2.raw
  modified_base (376)..(376): a, c, t, g, unknown or other
  modified_base (436)..(437): a, c, t, g, unknown or other
tcagtcacgtactacacgaccggtgctcgatttagatcgtctgtgttgggtttgggcacaagaggcagcactcaggacaatctccagcatggcctggtctcctctcctcctcactcctcctcgctcactgcacagggtcctgggcccagtctgtactgacgcagccgccctcagtgtcgtcggggcccccgagggcaggagggtccaccatcctcctgcacgtgggagcagcctccaacagttgggcacattatgatgtacactggtaccagctagtttccaggagcgacggtcccagacctcctcatcaataagtaaacaaacaagtccggcccgacgacggggtccctacgaccgtattctcgtcggcctccgnggtcctcggccaccctcacgtccctcccgtgtccactcacgtgggcctccgagctggagnnggagctagtatttattctcgtccagtcctagtcgacagcacgcctgagttcgtcgttacgggtacgttccgggggaccgggggaccctaggtccgtcggaaccccgttcgtaacggtccaaccggtaccccgaaccggg

SEQ ID NO: 390786 - DNA, 543 bp, Homo sapiens
  misc_feature: GZ8MTXP02I1EFJ.13.34.D01.1.454.CMB.2.raw
  modified_base (302)..(302): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctnatttatggtgcatccacgtaggccactggtctcccagtcaggttcagcgcaggtggtctgggacagacttcgactctcacctatccagcacgcctgacgtagtctagaagttatttcggactacgttctattacgtgttcaggctagtatacgttacgtaggtacgtaccgttcggacgaaacgggtacaacggtacgtggaaagtaagttaaacggaacgtagtacggtacgtcgaaccg

SEQ ID NO: 390787 - DNA, 574 bp, Homo sapiens
  misc_feature: GZ8MTXP02HFMWH.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctcagggaatagcaacctctcctgcagggccagtcagagtgttagcagcagcttagcctggtaccagcagagccgtggccaggctcccaggcctcctctatttatggtgcactccacgtacggccagtggtccgtcccagtcaggttcaggcggcgagggtgggtcgtgggacgtagacttcgactctccaccatcgagcacgcctgcagtcgtagtaagttgtttcgactagttcttaattacgtgtacgagtacgtaagttagttaacgttacgtaacgggtacgttaaaccgttccgggaacgaaacgggtaccaaccggtaggtaggaaagtaaagttaaacgggacgttaggtacggacttcgaaccg

SEQ ID NO: 390788 - DNA, 557 bp, Homo sapiens
  misc_feature: GZ8MTXP02IUH7Y.13.34.D01.1.454.CMB.2.raw
  modified_base (309)..(309): a, c, t, g, unknown or other
  modified_base (395)..(395): a, c, t, g, unknown or other
  modified_base (442)..(442): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagcaaccctctcctgcagggccagtcagagtgtagcagcagcttagcctggtaccagcagaagcctggccaggcctcccgaggctcctcatttanggtgcatccacgtagggccacgtggtcgtcccagtcaggttcaggcggcgaggtgggtcgtgggacagtacttcactctcacatcngcagcctgcagtctagaattatttgctagttcttaattacctgtacngactagttatagtttacgtacggacgtaaaccgttcgggaccgtaaacgggactaaccggaacgttaggggaaagtaacgtttaaaacgggaacttggtacggtacgtacggacc

SEQ ID NO: 390789 - DNA, 545 bp, Homo sapiens
  misc_feature: GZ8MTXP02FQ22P.13.34.D01.1.454.CMB.2.raw
  modified_base (309)..(309): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggggaaatagcaaccctctcctgcagggccagtcagagtgttagcagcagcttagcctggtaccagcagaagcctggccaggctcccaggctcctcatttanggtgcatcccacgtacggccacgtcggtcgtccccagtcaggttcacggcggcagggtcgggtctggggacaggtaccttcactctccacactcagcacgcctagcagtctagaagtatttgctagtcttattactgtcagactagtagtacgttagtacggtacgtaccgttacggacgaacggactaaccgtagtagaagtaagtaaacggtacgtggtacggtctacgtaccg

SEQ ID NO: 390790 - DNA, 699 bp, Homo sapiens
  misc_feature: GZ8MTXP02IMY9Q.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaagggaaatgccaacctctcctgcgagggccagtcagagtgtagcagcagcttagcctggaccagcaagacgcctggccaggcctcccgaggtcctcctactattttacgtggtcgactactcccgaacggtacgggccctacggttcgggtcccgtacccccgtaagtccgtacgggtttcgacgggtccgggcgtagggggttcgggtaccggtaggggaacctaacggtacctttccgaacccttcctacccaaacccctagttaccgaacggccacggtacccttcggaccgtacgttaccgttaaggtaaacgtttagttttacgacgttaacggttacctttaaagtttaccgttcggttactacgtacgtaaagttagttaacgttacgtaaggtaacgtaaacccgttcggaaaccgtaaacgggtaccaacggagtaagggtaacgtaaagttaaaacggacttaggtcggtactacgaacccg

SEQ ID NO: 390791 - DNA, 514 bp, Homo sapiens
  misc_feature: GZ8MTXP02G482E.13.34.D01.1.454.CMB.2.raw
  modified_base (312)..(312): a, c, t, g, unknown or other
  modified_base (449)..(449): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaagcctggccaggctcccgaggcctcctctatttanggtgcatccatagggccactggtccgtcccagtcaggttcagcggcaggtggtctgggaccagacttcactctcacatcagcaccgctgcagtctagaatatttgactatactattactgtacagcagtatagtacnggactaccgtcggaccaagggacacgcgtaggaagtaagtaaaacggactaggtcgacgtagacc

SEQ ID NO: 390792 - DNA, 550 bp, Homo sapiens
  misc_feature: GZ8MTXP02I6Z6P.13.34.D01.1.454.CMB.2.raw
  modified_base (421)..(421): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaacgcctggcccaggcctccccgaggcctcctcatttatggtgcatccacgtacgggccacgtggtcgtcccagtcaggttcagcgcaggtgggtctggggacagacttcactctcaccatcagcacgcctgcagtctaggaagtntttgctagttcttattactgtacagactagttatagttacgtaggtacgtaccgttcgggacgaaacgggtaccgaacgtacgtaggaagtaagttaaaacggaacgttaggtacggactacggaaccg

SEQ ID NO: 390793 - DNA, 604 bp, Homo sapiens
  misc_feature: GZ8MTXP02GG8MU.13.34.D01.1.454.CMB.2.raw
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaagccgtggcccaggcctccccgaggtcctccctctatttagtggtgctactcccgaacgtaggggccctacggttggtcccgtccccgagttccgtaacgggttcacggtcgggcgtagggttggggtcgtagggggacctaggtaccttcgaccttctacccaccactacagcacgcctgcagtcgtagagtagtttgctagtcttattacctgtacgtagacgtaagttagttagttacgtacgggtacgtaccgttacggaccgaaagggtaccaacgacgtaggaacgtaagttaaacggacgtagtacggtacgtagtacc

SEQ ID NO: 390794 - DNA, 556 bp, Homo sapiens
  misc_feature: GZ8MTXP02GGN4H.13.34.D01.1.454.CMB.2.raw
  modified_base (430)..(430): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggcctcccaggctcctctatttagtggtgcatccacgtacgggcctacgtcggtccgtcccagtcaggttcaggcggcgaggtgggtcgtaggggacagtacttcactctcacatcagcacgcctgcagtctagaagtgtttcgntagttctattactgtcagctagttagtagttacgtaggtacgtaaccgttcgggaaccgtaaacgggaccaacggtacgtaggaagtaaagttaaaacggaacgtggtacggacgttaggaacccg

SEQ ID NO: 390795 - DNA, 535 bp, Homo sapiens
  misc_feature: GZ8MTXP02IRKLV.13.34.D01.1.454.CMB.2.raw
  modified_base (397)..(397): a, c, t, g, unknown or other
  modified_base (445)..(445): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggcctcctctatttagtggtgctactccacgtacgggcctacgtggtcgtccccagtctaggttcaggcggcgaggtggggtctgggacagacttcactcncacatcagcagcctgcagtctagagtatttgctagtctattactgtanagactagtatagttacgtaggtacgtaccgttcggacgtaaaggacacgtacgtaggaagtaagttaaacgactaggtcgtacgtacgac

SEQ ID NO: 390796 - DNA, 530 bp, Homo sapiens
  misc_feature: GZ8MTXP02HDHIG.13.34.D01.1.454.CMB.2.raw
  modified_base (310)..(310): a, c, t, g, unknown or other
  modified_base (314)..(314): a, c, t, g, unknown or other
  modified_base (423)..(423): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagcttagcctggtaccagcagaagcctggccaggcctcccgaggcctcctcatttanggtncatcccacgtacgggccacgtggtccgtcccagtcaggttcagcggcgaggtgggtcgtgggacagacttcactctccaccatcagcacgcctgctagtctagaagttntttgctagtcttattactgtacagctagttatagttacgtgacgtaccgttcggaccgaaagggacacgacgtaggaagtaacgtaaaaggactaggtcgagtcacg

SEQ ID NO: 390797 - DNA, 550 bp, Homo sapiens
  misc_feature: GZ8MTXP02I8NST.13.34.D01.1.454.CMB.2.raw
  modified_base (308)..(308): a, c, t, g, unknown or other
  modified_base (312)..(312): a, c, t, g, unknown or other
  modified_base (380)..(380): a, c, t, g, unknown or other
  modified_base (397)..(397): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagcttagcctggtaccagcagaagcctggccaggctcccaggtctcctcatttanggtncatccatacggccagtgtcgtcccagtcaggtcagcgcagtggctgggacagacttcactcgtcaccntcagcacgctgcagtcngaagtatttgctagtctaattacgtgtacagctaggttatagttaacgtggtaacgtaacccgttacgggaccctaaacggggacctaaccgtacgtagggtaaagtaaacgtttaaaaggggaaacctaggtaacggtcgtacggtaacccg

SEQ ID NO: 390798 - DNA, 511 bp, Homo sapiens
  misc_feature: GZ8MTXP02F7Z1R.13.34.D01.1.454.CMB.2.raw
  modified_base (303)..(303): a, c, t, g, unknown or other
  modified_base (313)..(313): a, c, t, g, unknown or other
  modified_base (455)..(455): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggctcctnatttatggtncatccgactagggccacgtggtccgtcccagtcaggttcagcgcaggtggtcgtagggacaggtacttcgactctcacatcagcacgctgcagtctagaagtatttgactagtactattacgtgtacagacagtatagtacngtacgacttcgacaacggacacgacgtagaagtaagttaagacgtgacgctacgac

SEQ ID NO: 390799 - DNA, 523 bp, Homo sapiens
  misc_feature: GZ8MTXP02HHQ1F.13.34.D01.1.454.CMB.2.raw
  modified_base (311)..(311): a, c, t, g, unknown or other
tcagtcacgtactacacgaccggtgctcgatttagatcgtctgtgttgggtttggggagagctctggggaggaactgctcagttaggacccagacggaatcatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaacgcctggccaggcctcccaggcctcctcatttanggtgcatcccaacgtacgggccactcggtcgtcccagtcaggttcagcggcaggtgggtctggggacagactcactctcacatcagcagcctgcagtctagtaagtatttgctagtacttattactgtcagctagtatagttacgtaggtacgtaccgtcggaccgtaacgggacacgacgtaaggagtaagtaacggactggtcgactacg

SEQ ID NO: 390800 - DNA, 579 bp, Homo sapiens
  misc_feature: GZ8MTXP02HQN4C.13.34.D01.1.454.CMB.2.raw
  modified_base (317)..(317): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagagcctggccaggctcccgaggtcctcctctatttagtggtnctactccacgtacgggccacgtggtccgtccccagtcgaggttcgagcgggctaggtgggtcgtggggacaggaccttcactctcacactcagcacgcctgcctagtcgtagtaacgttattttacgactagttaccttatttaccgtgtactaagtctaagttaagtaagttaacgtacggtacgtaaccgttacggaccgtaaacgggacacgtacgtaggaagtaaagttaaaacggacgtagtacggtactacgaccg

SEQ ID NO: 390801 - DNA, 593 bp, Homo sapiens
  misc_feature: GZ8MTXP02IH06F.13.34.D01.1.454.CMB.2.raw
  modified_base (399)..(399): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcaagaagcctggccaggcctcccagggcctcctctaatttagtggtcgacatcccaacgtacgggcctacgtggtccgtccccagtcaggttcaggcggcaggtgggtctgggacagacttcactcncaccatcagcacgcctgccagtctagtaaagttattttcgctagttcttaatttcgtgttacagtactagttaagttaagttacgtacggtaaacgtaaccgtttcgggaaccgtaaacggggaccaaccggtacgtacggggaagtaaacggttaaaagggtaacgttacggtacggtaccgtacggaacccg

SEQ ID NO: 390802 - DNA, 572 bp, Homo sapiens
  misc_feature: GZ8MTXP02JJK86.13.34.D01.1.454.CMB.2.raw
  modified_base (307)..(307): a, c, t, g, unknown or other
  modified_base (311)..(311): a, c, t, g, unknown or other
  modified_base (392)..(392): a, c, t, g, unknown or other
  modified_base (402)..(402): a, c, t, g, unknown or other
tcagtcacgtactacacgaccggtgctcgatttagatcgtctgtgttgggtttgggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatgcaaccctctcctgcagggccagtcagagtgttagcagcagcttagcctggtaccagcagaagcctggccaggcctccgaggcctcctcatttanggtncatccacgtaggcctacgtgtcgtcccagtccaggttcaggtcgctagtcgggtctgggacagacttcgactctcacctancagcacgtcngactacgtcgtagtattagtttcgactagttacttaagttcgtcgtacacgtacgttaagttacgttacgttacgtacggtaacgttaccggttacggaccggaaacggaccgtaacggtacgtaaggtaacgtaacgttaaaacggacgttaggacggtacgtacgacg

SEQ ID NO: 390803 - DNA, 518 bp, Homo sapiens
  misc_feature: GZ8MTXP02JIXVY.13.34.D01.1.454.CMB.2.raw
  modified_base (306)..(306): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagctagcctggtaccagcagagcctggctaggctcccaggctcctcatttanggtgcatccactagggccagtggtccgtcccagtcaggttcagcgcaggtgggtctgggacagacttcactctccacatcagcacgctgcagtctagaagtatttgctagttctaattactgtacagtcagtatagtacgtaggacgtaccttcggaccgtaacggggacaacggtacgtaggaagaagttaaacggacgtgtcgactgacc

SEQ ID NO: 390804 - DNA, 542 bp, Homo sapiens
  misc_feature: GZ8MTXP02JR36B.13.34.D01.1.454.CMB.2.raw
  modified_base (304)..(304): a, c, t, g, unknown or other
  modified_base (355)..(355): a, c, t, g, unknown or other
  modified_base (398)..(398): a, c, t, g, unknown or other
  modified_base (413)..(413): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgcttacgcagtctccagtcaccctgtctgtgtctccagggaatagcaaccctctcctgcagggccagtcagagtgttagcagcagcttagcctggtaccagcagaagcctggccaggctccaggctctcatttanggtgcatccactagggccacgtggtctcccccagtcagggttcaggcggcnggtggggtctggggacagacttcactctcacatcagcagcctnccagtctgaaagttntttgactagttcttattactgtcagtctagttagttagttacgtaggtaacgtaccgttcggaccgtaacggacgacggtacgtaggaagtaagttaaaacggtacgtacggtacgtcgtacgactacg

SEQ ID NO: 390805 - DNA, 578 bp, Homo sapiens
  misc_feature: GZ8MTXP02JSVNC.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccaccctgtctgtgtctccgaaggggaaatagcaaccctctcctgcagggccagtcagagtgttagcagcagcttagcctggtaccagcagaacgcctggccaggcctcccgaggtcctcctctatttagtggtgctactccacgtacgggcctacgtggtccgtcccagtcgtaggttcaggcggcgtagggtggggtctggggacacggtacttcactcctacaccatcagcacgcctgcagtctagagttatttgactagttctaattacgtgttacagtactagttagttagttacgtaggaacgtaccgttcggaaccgtaaacgggaccaacggtacgtagggtaagtaaaggttaaaaggacgttaggtacggtcgtacgaccg

SEQ ID NO: 390806 - DNA, 545 bp, Homo sapiens
  misc_feature: GZ8MTXP02IBQLH.13.34.D01.1.454.CMB.2.raw
  modified_base (300)..(300): a, c, t, g, unknown or other
  modified_base (307)..(307): a, c, t, g, unknown or other
  modified_base (311)..(311): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagcttagcctggtaccagcagaagcctggccaggctcccaggctccncatttanggtncatccacgtagggccacgtggtcgtcccagtcaggttcagcgcaggtgggtctggggacagtacttcactctcaccatcagcacgcctgcagtctagaagtatttgctagtctattactgtacagctagtagtagttacgtaggtaacgtaaccgttcggaccgtaaaggggaccacggaaccgttagggaagtaaagttaaaacggaacgtaggtacggacttacggaacccg

SEQ ID NO: 390807 - DNA, 545 bp, Homo sapiens
  misc_feature: GZ8MTXP02GPTDZ.13.34.D01.1.454.CMB.2.raw
  modified_base (224)..(224): a, c, t, g, unknown or other
  modified_base (308)..(308): a, c, t, g, unknown or other
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctntcctgcagggccagtcagagtgttagcagcagcttagcctggtaccagcagaagcctggccaggctcccaggctcctcatttanggtncatccagtaggccacgtggtccgtcccagtcaggttcaggcggcgaggtcgggtcgtaggggacagacttcactctcaccatcagcacgcctgacagtctagaaagttatttgactagttacttattacgtgtactagtactagtagtagttacgtacgtacgtaaccgtacggtacgaacggacgacgacgtaggaagtaagtaaacgtaacgtagtacgtacgtacgtacg

SEQ ID NO: 390808 - DNA, 533 bp, Homo sapiens
  misc_feature: GZ8MTXP02FRF0G.13.34.D01.1.454.CMB.2.raw
  modified_base (271)..(271): a, c, t, g, unknown or other
  modified_base (305)..(305): a, c, t, g, unknown or other
  modified_base (311)..(311): a, c, t, g, unknown or other
  modified_base (315)..(315): a, c, t, g, unknown or other
  modified_base (426)..(426): a, c, t, g, unknown or other
  modified_base (439)..(439): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccngcagacgcctggccaggcctccccaggcctcctnatttanggtncactccacgtacgggccacgtggtccgtccccagtcgaggttcagcggcaggtgggtctggggacaggacttcactctacacatcagcagcctgcagtctagaatatttgntagttctattacngtacagtctagtatagttacgtacggacgtaaccgttcggaccgaacggacgacgacgtaggaagtaagtaaaggaacgtgtacggctacgacg

SEQ ID NO: 390809 - DNA, 544 bp, Homo sapiens
  misc_feature: GZ8MTXP02GRE9C.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaagcctggccaggctcccaggcctcctcatttatggtgcatccactagggccacgtggtctccccagtcaggttcaggcggcgagggtgggtcgtggggaccaggacctttcactctacaccatcagcacgcctgcagtctagaagtgtttgcgtagttactattacgtgttcgagtctagtatagttacgtaggtacgtacccgttcggaccaacggggacctacgacgtaggaacgaagttaaaggacgtggtacgacgtacgacc

SEQ ID NO: 390810 - DNA, 606 bp, Homo sapiens
  misc_feature: GZ8MTXP02GTPNT.13.34.D01.1.454.CMB.2.raw
  modified_base (306)..(306): a, c, t, g, unknown or other
  modified_base (310)..(310): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagctagcctggtaccagcagagcctggccaggctcccaggcctcctctatttnggtncatccacgtagggccacgttggtaccgtccccagtcgacggttacgacggcggccgagggtcggggttcgtacggggacgaggtaccttcctaccgtccttcccaccacgttacacgacgacgccctggccagtctagaagtagtttgacgtagttacgttattaactcggttcagtacgtagttacgttaagttaccgtaaggtacgtaaccgtttaccgggacaaacggggaccgaaacgacgttacgggaagtaaacgttaaaacgggactagggttacggtcgtacgtaccg

SEQ ID NO: 390811 - DNA, 482 bp, Homo sapiens
  misc_feature: GZ8MTXP02FIEOR.13.34.D01.1.454.CMB.2.raw
  modified_base (403)..(403): a, c, t, g, unknown or other
  modified_base (439)..(439): a, c, t, g, unknown or other
  modified_base (442)..(442): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggaaatagcaaccctctcctgcagggccagtcagagtgttagcagcagcttagcctggtaccagcagaagcctggccaggcctccccaggcctcctcatttatggtgcatccactagggccactggtcgtccccagtcaggttcagcggcagtggtctggacagacttcactctcaccatcagcagcctgcagtcngagatttgcagtctattctgtcagcagtatagtacnganacctcggcaggcacgactggaagattaaggactgtgctgc

SEQ ID NO: 390812 - DNA, 540 bp, Homo sapiens
  misc_feature: GZ8MTXP02IAIBI.13.34.D01.1.454.CMB.2.raw
  modified_base (463)..(463): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccgaggcctcctacattttagtgggtcgacatcccacgtaacggggcccaacgttggtcccgtacccctagtccaagggttcaggcgggctagggtcgggtctggggaaccaggacttcactctcacatcagcagcctgccagtctagaagtatttgactagtctattacngtacagctagtatagtactggagtaccgtcgacgaaggacacgactaggaagtaagtaaaggactgtacggctagac

SEQ ID NO: 390813 - DNA, 511 bp, Homo sapiens
  misc_feature: GZ8MTXP02HGDUB.13.34.D01.1.454.CMB.2.raw
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggcctcctcatttatggtncatccacgtagggccacgtggtcgtcccagtcaggttcaggcgcaggtgggctggggacagacttcactctcacatcagcagcctgcagtctagaagtatttgctagttctattactgtacagctagtactagtactgagtactcggacaagggtacacgactaggaagtaagttaaacggactggtcggactcgac

SEQ ID NO: 390814 - DNA, 551 bp, Homo sapiens
  misc_feature: GZ8MTXP02GKTVF.13.34.D01.1.454.CMB.2.raw
  modified_base (317)..(317): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggcctcctctatttagtggtnctatccgacgtacgggccacgtggtcctccccagtcaggttcaggcggcagggtgggtcgtggggacagtacttcactctcaccatcagcacgcctgctagtctagaagtatttgactagttcttattactgtacagctagttattagttactaggtaacgtaccgttacggaccgaaacgggacaacgacgtaggaagtaagttaaaacggacgttggtacggacgtacgacc

SEQ ID NO: 390815 - DNA, 578 bp, Homo sapiens
  misc_feature: GZ8MTXP02GAF57.13.34.D01.1.454.CMB.2.raw
  modified_base (301)..(301): a, c, t, g, unknown or other
  modified_base (312)..(312): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagagcctggccaggctcccaggctccntatttatggtncatccacgtaggggccacgtggtcctccgagtctaggttcaggcgcgaggtgggtctgggacagtacttcactcgtaccaccatcacgcacgtccctcgcgagtcgtaggtaacgtagttttcggactacgttacttatttaacgtcgtacagtactaagtagttacgttacgtaggtaccgtaaccgttcgggaaccgtaacgggacgaacggtacgtagggaacgtaaagttaaacggacggtaggtacggtacgtacgaaccg

SEQ ID NO: 390816 - DNA, 549 bp, Homo sapiens
  misc_feature: GZ8MTXP02HM5JQ.13.34.D01.1.454.CMB.2.raw
  modified_base (217)..(217): a, c, t, g, unknown or other
  modified_base (337)..(337): a, c, t, g, unknown or other
  modified_base (363)..(363): a, c, t, g, unknown or other
  modified_base (446)..(446): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctgggccccagggcagaggtcacatctcctgcacgtgggancagctccaacagttggggcacattatgatgtacactggtaccagcagttccaggagcaggtcccagcctcctcaatcaaatagtaaaacaaacaagtccggaccccgcgacggggtcccncgaacccgtattcctcgtgcctccgnggtctcggccacctcacgcctccctgtcatcacgtcggctcgagctgacgatgagctagtatttagttctcgcctagtcctanacgacagcgacgtcgtgtacgtcgtcgtttacggtacggttccggggaccgggggacccaggccgtacggaacccgtcggttacggccaacgacccggaacgg

SEQ ID NO: 390817 - DNA, 642 bp, Homo sapiens
  misc_feature: GZ8MTXP02II1S7.13.34.D01.1.454.CMB.2.raw
  modified_base (472)..(472): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgtagcagcagcttagcctaggtaccagcagaagcctggccaggcctcccgaggcctcctactatttagtggtcgactactaccgaacgtacggggccctaacgtgggttacccgtaccccgaggtcgtaagggtttcacgggtccggcgtagggtcggggtccgtaggggaacctaggtaccttcgactcaccacatcagacacgcctgctagtcgtagaaatttntttacgactacgttacttaacttacgtgttacaggtactaaagttagttaacgttacgtacgggtaaacgtaacccggttacggaaccggaaacgggtaccgaaacggtacggaagggtaaacgtaaaggttaaaacgggaccgttagggtccggaacgttacgtaaccg

SEQ ID NO: 390818 - DNA, 583 bp, Homo sapiens
  misc_feature: GZ8MTXP02H374T.13.34.D01.1.454.CMB.2.raw
  modified_base (246)..(246): a, c, t, g, unknown or other
  modified_base (329)..(329): a, c, t, g, unknown or other
  modified_base (366)..(366): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggagcagctccaacagttggggcacattangatgtacactggtaccagcagtttccaggagcaggtcccagacctcctcatctaaatagtaaaacaacaagtccggaccccgngaacggggtccctggacccgtattcgcgtcggctccnggtctggccctactcacgccctcccgtgtcatcacgtcggcctacgaggtcctggaggtacgtggacggtctagttaatttagtttccgtagacctacgttacctagttcgaacgtacgcgacgtacctggtacgttcgtacgttcgggtacgttccggggaccgggggtacccaggtccgtcggaacccgtccgtacggtccgacgacccgaccgg

SEQ ID NO: 390819 - DNA, 617 bp, Homo sapiens
  misc_feature: GZ8MTXP02F3MPZ.13.34.D01.1.454.CMB.2.raw
  modified_base (309)..(309): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagcaaccctctcctgcagggccagtcagagtgttagcagcagcttagcctggaccagcagaagcctggccaggcctcccaggcctcctcatttanggtgcatccagtagggccagtcggtccgtcccagtcacggttcacggtcggcgtaggtcggggtctaggggacaggtacttcgactctcaccatcagcacgactacgactacgaagtacgtttagcttacctttatttcgttacgtactacctagttacgtacggttacggtaccgtaccgttacgtacgtttttacgggacccggtacgggggtaacccgtaaacggtacgtacgggtaacgtaacgttaacgaaacggacccggtaaaacgttcggggtacgggtccttacggtaaccgtaacccg

SEQ ID NO: 390820 - DNA, 619 bp, Homo sapiens
  misc_feature: GZ8MTXP02JYN41.13.34.D01.1.454.CMB.2.raw
tcagtcacgtactacacgaccggtgctcgatttagatcgtctgtgttgggtttgggggagagctctgggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctccaggctcctcatttagtggtgcactccacgtagggccacgtggtccgtcccagtcaggttcagcgggcaggtggggtctggggacagtacttcacctctacaccatcagcacgcctgcagtctaggtaacgtagttttgactacgttcttaatttcgtacgttacaacggtactaagtttaagttaaacgtttaaccgtagggtaacggttaaaacccgttaccggggaaccggtaaaacggggtaaccgaaccggtaacgttaaggggaaaggttaaaacgttaaaacgggtaacggttacggtacgggtacgttacgaacccg

SEQ ID NO: 390821 - DNA, 538 bp, Homo sapiens
  misc_feature: GZ8MTXP02GAIQR.13.34.D01.1.454.CMB.2.raw
  modified_base (302)..(302): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgtagcagcagcttagcctggtaccagcagaagcctggccaggcctcccaggctcctnatttatggtgcatcccatacgggccacgtggtccgtcccagtcaggttcagcggcaggtcgggtctagggacagtacttcactctaccacatcagcacgcctgcagtctagaagtatttgactagtcttattaccgtgtacagtactagtatagttactggactaaccgttacggaccgtaaaggaccaacgacgtaggaagtaagttaaaacggaacgttggacgtctaggaacc

SEQ ID NO: 390822 - DNA, 564 bp, Homo sapiens
  misc_feature: GZ8MTXP02JCDCI.13.34.D01.1.454.CMB.2.raw
  modified_base (278)..(278): a, c, t, g, unknown or other
  modified_base (309)..(309): a, c, t, g, unknown or other
  modified_base (397)..(397): a, c, t, g, unknown or other
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagancctggccaggctcccaggctcctcatttagnggtcgcatccacgtagggccacgtcggtccgtccccgagtcgacggttcaggcgcgagtgggtcgtgggacagacttcacctctcacntcagcacgctgcagtctagagtatttcgctagtctattctgtactagactagttaagtgttaacgtacggtacgtaacccgttcggaaccgaaaacggggaccaacggtaccgtaggaaacgttaaaacgttaaaagggtaaactggttacggacttacggtaaccg

SEQ ID NO: 390823 - DNA, 527 bp, Homo sapiens
  misc_feature: GZ8MTXP02HYEHE.13.34.D01.1.454.CMB.2.raw
  modified_base (306)..(306): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctctgcagggccagtcagagtgttagcagcagcttagcctggtaccagcagaagcctggccaggctcccaggctctcatttanggtgcatccatagggccacgtggtcgtcccagtcaggttcaggcggcaggtggtctggggacaggacttcactctcaccatcagcacgcctagcagtcagtaagtattttgctagtcttattatgtcagctagttatagttactcggacgtaccgttacggaccgaaagggaccacgaacgtaggaagtaagttaaaaggactaggttacggcgtacgacc

SEQ ID NO: 390824 - DNA, 523 bp, Homo sapiens
  misc_feature: GZ8MTXP02IIQ4C.13.34.D01.1.454.CMB.2.raw
  modified_base (364)..(364): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcactccactaggggcccacgttcggtcgtcccccagtcaggttcaggcgggnaggtgggtctggggacagacttcactctcaccatcagcagcctgcagtctagaactatttgctagtctattactgtcagctagtaatagttactggagtaaccttcggaacaagggaccacgacgtaggaagagttaaaggaactaggtcgcgtagacc

SEQ ID NO: 390825 - DNA, 569 bp, Homo sapiens
  misc_feature: GZ8MTXP02JXXWI.13.34.D01.1.454.CMB.2.raw
  modified_base (241)..(241): a, c, t, g, unknown or other
  modified_base (243)..(243): a, c, t, g, unknown or other
  modified_base (270)..(270): a, c, t, g, unknown or other
  modified_base (287)..(287): a, c, t, g, unknown or other
  modified_base (290)..(290): a, c, t, g, unknown or other
  modified_base (349)..(349): a, c, t, g, unknown or other
  modified_base (428)..(428): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacaggtcctgggcccagtctgtactgacgcagccgccctcagtgtctggggcccccagggcagaggtcaccatctcctgcactggagcagctcaacattggggcacattangntgtacactggtaccagcagttccaggngcaggtcccagactccncancaaatagtaacaaacaatccggcccgcacggggtccctcgaccgtattctctggctccnggtctggcacctcagcctccctgtcatcactgggccttccagggctcggaggacgtggaggcttagatttagttttccnggcccagttccctatgaccagctagcccgtgtacgttgtcgtttacggggtacgtttacccgggggccggggggtaccccaggtccgtcggtaaccccggttacccgttaggttacccgacggacccccgtaaaaccgggg

SEQ ID NO: 390826 - DNA, 523 bp, Homo sapiens
  misc_feature: GZ8MTXP02F3HT0.13.34.D01.1.454.CMB.2.raw
  modified_base (306)..(306): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaacctctcctgcagggccagtcagagtgttagcagcagcttagcctggtaccagcagaagcctggccaggctccaggctcctcatttanggtgcatcccatagggccacgtggtcgtcccagtcaggttcagcggcagtgggtctgggacagacttcactctcacatcagcagcctgcagtctagagatttgcagttctattactgtcagcagtatagttactagacgtaaaccgttcggacccaaaggggacaacgaccgttaggaagtaaagttaaaacggaactaggtaggactacggaaccc

SEQ ID NO: 390827 - DNA, 631 bp, Homo sapiens
  misc_feature: GZ8MTXP02H7NMC.13.34.D01.1.454.CMB.2.raw
  modified_base (219)..(219): a, c, t, g, unknown or other
  modified_base (245)..(245): a, c, t, g, unknown or other
  modified_base (357)..(357): a, c, t, g, unknown or other
  modified_base (592)..(592): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctctgcacgtgggancagctaccaacagttgggcacattangatgtacacgtggtaccagtcagttccaggtagccgacggtaccccagtacctccgtacatacaaaattaacgtaaacaaactaacgtccggacccgacgtacggggtcccncgaccgtacttcgtcgtacggccttacgtcggtcctggaccctaccgtcgaccgtcccgttcccgtcggttcctacgtcccgtacgttcgggcccgttaccgaacgggtccgttaagggacgggtagtacgggaggtacgttaggtattttacgtttcgacgtcccgtagtccctagtcgactacgcgacgtcgtagcgttcgtcgttacggtacgggttcgggcggggaacccnggtcgtcgacccggtacgtagaccgtacgaccgtaccgg

SEQ ID NO: 390828 - DNA, 550 bp, Homo sapiens
  misc_feature: GZ8MTXP02FZH60.13.34.D01.1.454.CMB.2.raw
  modified_base (310)..(310): a, c, t, g, unknown or other
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggctcctcatttanggtncatccactagggccacgtggtccgtcccagtcaggttcaggcggcgagtggggtctggggacagtacttcactctccacatcagcacgcctgcagtctaggtaagttattttgctagttcttattactgtcagtctagtattagttacgtaggtacgtaaccgttcggaccgtaaagggaccaacggtacgtagggaacgtaaggttaaaacggacgtaggtacggacgtacgacc

SEQ ID NO: 390829 - DNA, 691 bp, Homo sapiens
  misc_feature: GZ8MTXP02JUHEN.13.34.D01.1.454.CMB.2.raw
  modified_base (319)..(319): a, c, t, g, unknown or other
  modified_base (323)..(323): a, c, t, g, unknown or other
tcagtcacgtactacacgaccggtgctcgatttagatcgtctgtgttgggtttggggagagctctgggggaggaactgctcagttaggacccagacggaaccatggaagccccagcgcagcttctcttcctcctgctactctggctcccagatactactggagaaatagtgctgacgcagtctccagtccaccctgtctgtgtctccgaaggggaaatagccaaccctctcctgcagggccagtcagtagtgttagcagcagcttagcctggaccagcagaacgcctggccaggcctcccgaggcctcctctatttagnggtnctactcccacggtacggccctacgtggtcccgtcccagtcgtaggtccaggcgcgagggttcggggtcgtaggggactaggtacctttaccaccgttcctacccaacctaacgtccacgaccgacgtcccgttcgaccgtacgttacgtaggtaagtttaacgttttggaccttacggttactttaagtttacctcggttactaacgtacttaaggtttagttaacggttaacggtacggggtaaaccgtaacccggtttacgggaaacccggtaaacgggtacccgtaaaccggtaacggttaagggaaacggttaaaaggtttaaaacgggtaacggttagggtacggttacgtaacggtaacccg

SEQ ID NO: 390830 - DNA, 649 bp, Homo sapiens
  misc_feature: GZ8MTXP02JKLH7.13.34.D01.1.454.CMB.2.raw
  modified_base (315)..(315): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagtctagcctggtaccagcagaagccgtggccaggcctacccaggcctcctctatttagnggtacgacactccaacgtacggcctacgtcggtccgtacccgagtcgaaggttcgaggtcgggcgtagggttcggggtaccgtaggggaacctaacgtaccgtttccaaccttcctaccaaccctaatccgaacgcacgcctagacacgttactaggaaagttagtttacgacgttacgtaccttattaaccgtgtaccgtaacgtacgttaagttaagttacgttaacgtacgggtaacgttaaacccgttacgggaaccgtaaaacggggacctaaacggtaacgtaggaaacgttaaagtaaaacggaactggtacggacgtacggaaccg

SEQ ID NO: 390831 - DNA, 562 bp, Homo sapiens
  misc_feature: GZ8MTXP02JRDZ8.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaagcctggccaggcctcccaggcctcctcatttactggtgcatccactaggggccacgtggtccgtcccagtcgaggttcaggtcggcgaggtgggtcctggggacaggtacttcactctcaccatcagcagccctgccagtctagagtattttgctagtactattacgtgtacagtcagttatagttacgtaggtacgtaaaccgttcggacccgaaagggtaccgaacggtaccgtaggaacggtaacgttaaaagggtacgtaggttaggcgttacggacccg

SEQ ID NO: 390832 - DNA, 626 bp, Homo sapiens
  misc_feature: GZ8MTXP02F5VM4.13.34.D01.1.454.CMB.2.raw
  modified_base (304)..(304): a, c, t, g, unknown or other
  modified_base (312)..(312): a, c, t, g, unknown or other
  modified_base (316)..(316): a, c, t, g, unknown or other
  modified_base (437)..(437): a, c, t, g, unknown or other
  modified_base (448)..(448): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggcctcccagatactactggagaaatagtgctgacgcagtctccagtcaccctgtctgtgtctccgaggggaaatagccaaccctctcctgcagggccagtcagagtgttagcagcagcttagcctggaccagcagacgctggccaggctcccaggcctcctntatttagnggtnctatccacgtacggcctacgtcggtccgtcccagtcgtacggttcgacggcggcgaggtcggggtcgtaggggacacggtaccttcactcctacacctatcagtaccacgcctcgcacgtnttagaaagttnttttagactacgttacttattaccgtgtacagtacgtagttaacgtaagtttacgtagggtaaaccgttaaacccgttccggggaaacccgtaaggggaacccgtaaccggtacggtaaagggtaaaacgtaaaaggttaaaaccggtacgttagggtacggtaactacggtaacccg

SEQ ID NO: 390833 - DNA, 717 bp, Homo sapiens
  misc_feature: GZ8MTXP02HRF56.13.34.D01.1.454.CMB.2.raw
  modified_base (317)..(317): a, c, t, g, unknown or other
  modified_base (324)..(324): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagctggtaccagcagaagctaggccaggcctccccgagggcctcctactatttacgngggtacnctactccacgtaaggggccctacgtggtaccccgtccccgtaaggtccgtaacggggtttcaacggggtccgggaccgtaacgggggtttgggggttcccgttaggggggaaacctaacgggttaaacccttttcccgaaacccgtttccctaccccggaaaccccgtattacccggaaacgcccgttaacggcccttcggggacctaacggttccgtaaaggtaaaacgggtttttacgttttacggacttacgtttaacttacgtttaaccgtcgtacgacgtaacttaagttaagttaacgttacggtaacggtaacgtaaccggtacggaacggaaacggactaacggagtaggaaagtaaagtaaacggtacgtgtacgtcgtacgac

SEQ ID NO: 390834 - DNA, 558 bp, Homo sapiens
  misc_feature: GZ8MTXP02JY90X.13.34.D01.1.454.CMB.2.raw
  modified_base (428)..(428): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccaccctgtctgtgtctccaggggaaatagcaaccctctcctgcagggccagtcagagtgttagcagcagcttagcctggaccagcagacgcctggccaggcctcccgaggtcctcctctatttagtggtgcactccagtacgggcctacgtggtccgtcccagtcgtaggttcaggcgcgaggtcgggtcgagggacagtaccttcacctctaccacatcagcacgctgcagtctagatnttgctagtctattctgtacagtctagttatacgttacgtcggtacgtaccgttcgggaaccgtaacgggacaaccgggtacgtaaggtaagtaaacggttaaacggaacgttggtacggtactgaacccg

SEQ ID NO: 390835 - DNA, 534 bp, Homo sapiens
  misc_feature: GZ8MTXP02HKOTW.13.34.D01.1.454.CMB.2.raw
  modified_base (390)..(390): a, c, t, g, unknown or other
  modified_base (523)..(523): a, c, t, g, unknown or other
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccgaaggggaaatagccaaccctctcctgcagggccagtcagagtgttagcagcagtctagctggtaccagcagacgcctggccaggcctcccgaggcctccgtctatttagtggtgccacttccacgtacgggccacgttggccgtcccgagtcgacggttcaggcggcgaggtgggctgggacngactcactcacacatcagcacgcctgacagtctaggacttatttgactagtacttatactgtcagtctagttatagtacgtggactacgtacggacgaacggacacggctaggaacgtaagtaacgacgtagngacctagaccg

SEQ ID NO: 390836 - DNA, 700 bp, Homo sapiens
  misc_feature: GZ8MTXP02HCXNA.13.34.D01.1.454.CMB.2.raw
  modified_base (223)..(223): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtcgtcggggccccagggcaggagggtcaccatctcctgcacgtgggancagctaccaacagttcggggacactattatgatgtacacgtggtaccagctacgtttccgaagggtagaccgacgggttaccccaaggtaacccttccctactaatacaaaacgttaacggtaaaacccaaacaacgtcccggaccccgtacggaccggggtcccacggtacccgtattccgtacgtcggcccgttaccgtacgggtcctacgggcctaccctaccgtacggtcccccttcccggtggtacctaaccgttccgaacggttccgggcccttaccggacgggtcgttacggggaaccggtagtacgggtacggtccgtttaggttacttttacgtttccgtacgtaccgtacgttaccgtagtacggacaacggcacgtccgtaggtcgttcggtacggttcgggtacgttccgggggaccgggtaccgtacggcgtcggtaccgtcggacgtcgacggtaccgaacgg

SEQ ID NO: 390837 - DNA, 692 bp, Homo sapiens
  misc_feature: GZ8MTXP02JU6DL.13.34.D01.1.454.CMB.2.raw
  modified_base (221)..(221): a, c, t, g, unknown or other
  modified_base (249)..(249): a, c, t, g, unknown or other
  modified_base (283)..(283): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagcccgccctcagtgtctcggggccccagggcagagggtcaccatctcctgcactgggancagctaccaacagttggggcactattangatgtacacgtaggtaccagctagtttccaggancgacggtcccagacctcctcatacaaagttaacgtaaacaaacaagtccggacccgcggaaccggggtccctacgacccgtatttcctacgtcggtccgttccacggggttcctgggtcccaacccttcgaccgtccccttcccgtggtacctactccgtaacgtcgggggcccttacccgagggtccgttacggacgggtacgtggtaaacgggtcctttaggtacctttttaagtttacctcgttacccgtaacgttaccctagttacgacgtaacgcgtaacgcctagggtacgtcggtccgttacgggttcggttaccgggggaccgggggtaacccgacggtcgtacccggtaacccggttaccggttaacggtacccggtaacggacccggtaaaccccgggg

SEQ ID NO: 390838 - DNA, 573 bp, Homo sapiens
  misc_feature: GZ8MTXP02HT200.13.34.D01.1.454.CMB.2.raw
  modified_base (492)..(492): a, c, t, g, unknown or other
  modified_base (533)..(533): a, c, t, g, unknown or other
tcagtcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctctgcactgggagcagctccaacagttggggcacattatgatgtacactggtaccagcagtttccaggagcaggtcccagctcctcatcaatagtaaacaacaacgtccggaccgccgacggggtccctcgaccgtacttctcgtcggcctccgtgggtcttcggcctacccgtcacgccctccccgtggtcactcacgtcggggccttccgaggtcctggaggagtcgagggtcttaggtattttattcgtgtccctagtccttagtcggacacgcgacgtcctagnggttcgtcgtttcggtacgttccgggggtacgggggaaccnggtccgtcggaccgttacgtacggtcacggtacccgacgg

SEQ ID NO: 390839 - DNA, 792 bp, Homo sapiens
  misc_feature: GZ8MTXP02IWP5P.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggcctccagatactactggaagaaatagtgctgacgcagtctccagtccacctgtctgtgtctacgaagggaaatagaccaaccctctcctgcgacgggccagtcgagtagtgtagcgagcagcttacgcccgtacggtaaccagacgaacgaacggccgtcggacccgacggtcctaccccgacggtcccttacctaccttagtttagtacggtcgtacctacgtacccgtacggtaccggggaccctaacggttccggtaccccgtaccccgtaggtaccgtacggttccgacgggtcggcggttacggggtcggggtacgtacggggaccgtaacgtaccttacccaccttccctacctaacccgtatcccgaacgacccgtacgtccccgtagtacgtaacgtcgttaaagtaaacgtttgtttacggactttaacgtttacgttaaacttaccgttagtacccgtaacggtaattaaacggtttaacgttaacgttaaccggtaacggttaaaccggttaacccgggttacgggaaaaccgggtaaaaccggtaccgaaaaccggttaacggtaaaaggggttaaaacggttaaaaggttaaaaccggttacggtacgggttaacggtaccgaacggtaaaccccg

SEQ ID NO: 390840 - DNA, 546 bp, Homo sapiens
  misc_feature: GZ8MTXP02F00YM.13.34.D01.1.454.CMB.2.raw
  modified_base (361)..(361): a, c, t, g, unknown or other
  modified_base (404)..(404): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgtagcagcagcttagcctggaccagcagaagcctggccaggcctcccaggcctcctctatttatggtgcatccacgtagggccactggtcctccccagtctaggttcacggcggnaggtggggtctggggactagcttcactctcacatcagcagtcngacagtctagaaagtattttcgactacgttacttaattactggtacaggtactagtaatagttacgtaggtaacgtaaccgttcggacgaacgggacacgacgttaggaagtaagtaaaaggacgtgtacggactaggaacc

SEQ ID NO: 390841 - DNA, 546 bp, Homo sapiens
  misc_feature: GZ8MTXP02IICZJ.13.34.D01.1.454.CMB.2.raw
  modified_base (313)..(313): a, c, t, g, unknown or other
  modified_base (317)..(317): a, c, t, g, unknown or other
  modified_base (361)..(361): a, c, t, g, unknown or other
  modified_base (373)..(373): a, c, t, g, unknown or other
  modified_base (379)..(379): a, c, t, g, unknown or other
  modified_base (458)..(458): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgagggaaatagcaaccctctcctgcagggccagtcagagtgtagcagcagcttagcctggtaccagacagaagcctggccaggcctccccgaggcctcctcatttagnggtnactataccactagggcccagtcgcgtcccagtcaggttcagcgntaggtggtccgnggaacngacttcgactctacacatcgagacacgctgacagtcaggtaaattattttgacgttagttacttaacttactgtatagntaagttatagttacgtaggtagaaaccttcggaacgaaacgggacgaacgtacgtaggaagtaaagtaaagtacgtagtaggctagac

SEQ ID NO: 390842 - DNA, 799 bp, Homo sapiens
  misc_feature: GZ8MTXP02G9D7O.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaaatagtgctgacgcagtctccagtcaccctgtctgtgtctccgaggggaaatagcaaccctctcctgcgagggccagtcagagtgttagcagcagtctagcctggtaccagcaggaacgccgtggccacggcctccccgagggtcctcccttactaagttttacgtgggtcgcctacgttcccctaacggtacggcccctacgttcgggttcccgtacccccgtaagttccggtaagggtttccgaacgggtcgggtccgtaaggggtttcgggggtaccggttagggggaacccgtaacgggtaccctttaccgaaccgttccctacccgaaccccgtaaattcccgaacgtaccgaaccgtcccgtacggaccctaaaggtttccgtaaaggtaaacggtttagtttttccggacgttaagtttacccgttaaatttacccgttaggtttaccaaggtaccttaaggtttaaactttaggtttaaccggttaagggttaaacccggttaaacccggttttaccgggaaaacccggttaaacggggtaacccgaaacggttaaccggtaagggtaaaacgttaaaggtttaaaaacggggaaccttgggtttacggaccgtttacgaaaccccg

SEQ ID NO: 390843 - DNA, 597 bp, Homo sapiens
  misc_feature: GZ8MTXP02F12XF.13.34.D01.1.454.CMB.2.raw
  modified_base (317)..(317): a, c, t, g, unknown or other
  modified_base (430)..(430): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaagcctggccaggcctcccaggcctcctctatttagtggtncactccacgtacgggccacgtggtcgtcccagtcaggttcaggcggcgaggtggggtctggggacagtacttcactctccacatcagcacgcctagctagtctagtaaagttntttgacttagttacttaacgttacgttgtacgtacgtacgtagttaagttacggttacgtacgggtaacgttacccggttacgggaaccgtaaacgggaccgtaacggtaacgtagggtaaacgttaaaacggttaaaacggtacgtacggtacggtacgtacgacc

SEQ ID NO: 390844 - DNA, 583 bp, Homo sapiens
  misc_feature: GZ8MTXP02F8IDZ.13.34.D01.1.454.CMB.2.raw
  modified_base (317)..(317): a, c, t, g, unknown or other
  modified_base (443)..(443): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagagcctggccaggcctcccgaggcctcctctatttagtggtcncatccacgtacgggcctacgtggtccgtaccccaggtctaacggttcgaggtccggcgtaggtcggggtcgtaggggacagaccgttcactctcgacctatcagtcagcctagcagtctagaagtnttagctagtctatactgtcagactagtaagtagttacgtaggtacgtaaccgttcgggaactaacggggaactaaccggacgttaaggaacggtaaacgtttaaaacgggaacgttaggtacgggtacttacggaacccg

SEQ ID NO: 390845 - DNA, 839 bp, Homo sapiens
  misc_feature: GZ8MTXP02H0WF7.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctcagtcacctgtctgtgtctcgagggaatgcacctctctgcaggccagtcagtgtgtagcagcagtctacgccgtaggtaccagcaagaacgccgtaggccctaggccctcccgaggtccttaccgtatagtttaacgtcgggtacgtacctaacgtcccgtaacggtacggggtaccccaacggttcgggtaccccgttaccccgtaacgttacgtacgggtttacacggggtcggcggttacgggtcggggttaccggtacggggaaacctcggttaaacctttcccgtaacccgttccttaacccgaaccctacgttaccgaaaccgtcccgtaaaccggtcccttacggggtaacctacggttacccggttaaaaaggggttacctttaaaagggttttctaaaccgggttaacgttttaacctttaaacgtttaaccgtcggggttaaaccctaaggtacgtttaaagtttaaacggttaaacggtttaaccggttaacggggtaaaaccggtttacccgggtttaaaccggggaaaccggtaaaacgggggtacccgtaaaaccggttacgggtaaaggtaaaaccggttaaaaggttttaaaaaccggggcgtttaagggggtacccgtaccggtttaaaacggtaccccg

SEQ ID NO: 390846 - DNA, 531 bp, Homo sapiens
  misc_feature: GZ8MTXP02H439P.13.34.D01.1.454.CMB.2.raw
  modified_base (352)..(352): a, c, t, g, unknown or other
  modified_base (367)..(367): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactaggccactggtcgtcccagtcaggttcagcgnagtgggtctgggacngacttcactctcaccatcagcagcctgcagtctagaagtatttgctagtcttattactgtacagactagtatagttacgtaggtacgtaaccgtttcggaccgaaacgggtaccgacgtacgtaggaagtaacgtaaaacggacgtaggtacggcgtacgtacc

SEQ ID NO: 390847 - DNA, 700 bp, Homo sapiens
  misc_feature: GZ8MTXP02GCCRC.13.34.D01.1.454.CMB.2.raw
  modified_base (163)..(163): a, c, t, g, unknown or other
  modified_base (328)..(328): a, c, t, g, unknown or other
tcagtcacgtactacacgaccggtgctcgatttagatcgtctgtgttgggtttggggagagctctgggggaggaactgctcagttaggacccagacggaaccatggaagccccagcgcagcttctcttcctcctgctactctggctcccagatactactgganaaatagtgctgacgcagtctccagtcaccctgtctgtgtcctaccgaaggggaaatacgaccaaccctctcctgcgacgggccagtcaggtacgtgttagcagcagtcttagccgtaggtacagcagacgcgtggccgagcctccgaggcctcctactatttagnggtacgtcactaccgacgtacgggcctacggtcgtcccgaccgagtacgtacgttcgacggcggtcgtcgggtcggggtacgttacggggaaccgtaagtaccgttacctaaccgttccctacccgaaccgtaactcgaacgaccgaccgtccgtacggacctacggttacgtaacggttaaagttacgtttcgtacgtaacgtttacgttaactttacgtcgttacgagttaccgtaaagttaagttacgggttaacggaaggttaccggtaaaccggttaccggaaaccgggtaaacggaacgtaaccgtacggtaacgggtaaacggtaaacgtaaaacggtacgtagtaccggacgtaccgtaaaccg

SEQ ID NO: 390848 - DNA, 550 bp, Homo sapiens
  misc_feature: GZ8MTXP02FG2C1.13.34.D01.1.454.CMB.2.raw
  modified_base (314)..(314): a, c, t, g, unknown or other
  modified_base (477)..(477): a, c, t, g, unknown or other
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggaccagcagaagcctggccaggcctcccaggcctcctcatttatggtncatcccacgtacgggccacgtggtccgtccccagtcgaggttccaggcggcagggtgggtctggggacaggacttcactctaccaccatcagcagcctgcacgtctagaagtatttcgctagtaccttaattacgtgtacagtcgagtacgttagttaaccgnggtaacgtaccgttacggacgaacgggacaacggacgtacggaagaacgttaaaaggacgttggcgacgcgac

SEQ ID NO: 390849 - DNA, 493 bp, Homo sapiens
  misc_feature: GZ8MTXP02FJXDF.13.34.D01.1.454.CMB.2.raw
  modified_base (305)..(305): a, c, t, g, unknown or other
  modified_base (312)..(312): a, c, t, g, unknown or other
  modified_base (316)..(316): a, c, t, g, unknown or other
  modified_base (353)..(353): a, c, t, g, unknown or other
  modified_base (442)..(442): a, c, t, g, unknown or other
  modified_base (470)..(470): a, c, t, g, unknown or other
tcagtcacgtactacacgaccggtgctcgatttagatcgtctgtgttgggtttgggggagagctctgggggaggaactgctcagttaggacccagacggaaccatggaagcccccagcgcagcttctcttcctcctgctactctggctcccagatactactggagaaaatagtgctgacgcagtctccagtcaccctgtctgtgtctccaggggaaatagcaaccctctctgcagggccagtcagagtgttagcagcagcttagccctggacccagcagaagcctggccaggctcccaggctccnctattanggtncatccactagggccactggctaccagtcaggttcagngcagtggtctgggacagattcactctcacatcagcagcctgcagtctagatatttgcagtctatacagtcagcagtatagtactagganaacttcgcaaagggacaacgctaggaanaataaaaggaaactgagtcagac

SEQ ID NO: 390850 - DNA, 782 bp, Homo sapiens
  misc_feature: GZ8MTXP02F9L0J.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatagaccaaccctctcctgcgacgggccagtcagagtgttagcagcagtcttacgccgtggtaccagcagaacgcctggccaggcctcccgaggtccctaccctcgtaatttagtcggtcgctaactccgacgtacggggccctaacggttcggtacccgtacccccgtaggtccgtaacgggttccgaagggtccggggtcgttacgggggttcgggggttaccggtacgggggtaaccctaacgggtaccctttacccgaacccttccgtaccccgaacctacgtaccgaaacgccgaccggtcccgtacggaccgttacgttaccgttaagttaaacggtttacttttacggacgttaacggtttactttaaacgtttaccgttagtacgtaacggtacgttaaaggtttaagttaacggttaacggttacggtaaaccggtttaacccgggtttaccgggaaaccggtaaacggggtaccgtaaaaccggtagggttaaacgggaaaaggttaaaacggttaaaacggggtaacgtcggggttacggtacgttaccgtaacccg

SEQ ID NO: 390851 - DNA, 690 bp, Homo sapiens
  misc_feature: GZ8MTXP02FXSGP.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggaagaaatagtgctgacgcagtctccagtcacctgtctgtgtctccgaaggggaaatagaccaaccctctcctgcagggccagtcagagtgttagcagcagcttagccttggaccagcagaagctcggccaacggcctcccgaggtcctaccgtctatttagtcggtcgaccgtaactccgaaacgtcggggacctaacgttcggttaccccgtacccacggttacgtaacgggtttacgacgggtccggcggtacgggttggggtacgtaggggaacctaggtaccttcaacgtcctaccgtacacgtcaacgtacacgtcctagactagtcgtaagtaagttagtttcgacgtacggttaacttacgttacgtcgttacgaagtacttaaggtaacttagggttaccgtacggtaaaccggtacccgtttacgggaaacccggtaaaggtaccgtaaacggtacgttaacgggaaacgttaaaggttaaaaacggtaaccggtggtaaccggtacgttcggtaaacccg

SEQ ID NO: 390852 - DNA, 719 bp, Homo sapiens
  misc_feature: GZ8MTXP02HQMB2.13.34.D01.1.454.CMB.2.raw
  modified_base (204)..(204): a, c, t, g, unknown or other
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtcctcagtcaccctgtctgtgtcnccgaggggaaatagcaaccctctcctgcgaggccagtcagagtgtagcagcagtctagcctaggtaccagcaagaacgcctcggccacggcctcccgaggtcctcctcctaagtttgtggtcgctacgtccgtacgtacgggccctacggttcggtccgtacccgtacgtacgtaggttccaggtccgggcgtacgggtcgggttcgtacgggggaactaacggtcctttacccgacgttctacccgtaacctacacgtacgacctaccgtccgttacgccgagttaccgtagttaaaggtttactttttacggacgtttacggttaactttacgtttaacccgtacggttaacgtacgtaacgttaaggtttaagtttacggtttaacccggtagggtaaccgtttaaacccggtaccgggggtaacccgaaaccggggtaccaaacgggtaccggttaggaaaagttaaacggtaaaacggtacgtacgggtttcgacggttaacgtaccccg

SEQ ID NO: 390853 - DNA, 820 bp, Homo sapiens
  misc_feature: GZ8MTXP02HDWA1.13.34.D01.1.454.CMB.2.raw
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtccaccctgtctgtgtctaccgaagggaatagaccaaccctctccgtgcgagggccagtcgagtagttgtagcagcagtcttacgccgtacggtaccagcaacgtaacgcccgtacggacccgaaccggccccccgaggtcccctccctactaagtttacgtcggtacgactaaccgtaccctacggtaccgggacctaccggttgggtccgtacccccgtagttaccgtagggttaccgacgggtccggacgtcgggggttcgggtacggtacggggaaactaccggtttacccttacgtacccgttaccgtaccctaaacccgtacgtaccgacggaccctaacgggtcccctaggtaccgttacggttacgtaaggttaaacgtttcgtttaacggaaccggttttacttaaccgtttaacgtttaaccgtacggtaccgtaaaggttaaccgtaaaagtttaaccgttttaaacggttaacgggtaaccgggttaaaaccgtacccgggttaaccggggaacccggtaaaaacggggtccctaaacgggtaaccggtaagggtaaaaccgtttaaaggttaaaacccggtacggttacggtaacggtactaaccgggtacccttaaaccg

SEQ ID NO: 390854 - DNA, 647 bp, Homo sapiens
  misc_feature: GZ8MTXP02GVD3Z.13.34.D01.1.454.CMB.2.raw
  modified_base (484)..(484): a, c, t, g, unknown or other
  modified_base (507)..(507): a, c, t, g, unknown or other
tcagtcacgtactacacgaccggtgctcgatttagatcgtctgtgttggggtttgggggagagctctgggggaggaactgctcagttaggacccagacggaaccatggaagccccagcgcagcttctcttcctcctgctactctggcctccagatactactggagaaatagtgctgacgcagtcctcagtccacctgtctgtgtctcggagggaaatcgccaacctctcctgcgacgggccagtcagtagtgtagcagcagcttacgccgttacggaccagacaggaacgcgtcggccacggcctaccgaggtcctcctatatttagtcggtcgacctactaccgtaacggtacgggacctacggttcggtcccgtcccggagttcggtacggttcgacggcggtacgtacggggtggggtaccgtaggggactaggtacctactactcctactacacgtacgacgctacgcgtaagcctagtntaagtattgtttcgacgttattntacgtactagtacgagtaactagttaacgttcgtaacgtaacgggtaacgttaccggtacggaaaccggtaaggacccgtaacgtaacggaaggtaagttaaaaggttaaacgggattaccggagtaccggtactaaccg

SEQ ID NO: 390855 - DNA, 761 bp, Homo sapiens
  misc_feature: GZ8MTXP02GP3K4.13.34.D01.1.454.CMB.2.raw
  modified_base (333)..(333): a, c, t, g, unknown or other
tcagtcacgtactacacgaccggtgctcgatttagatcgtctgtgttgggtttggggagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccgaggggaaatagccaaccctctcctgcagggccagtcgagagtgttagcagcagcttagccgtacggtaccagcagaacgccgtggccaggcctccccgaggtcctccctactatttagtcgggtcnctactcccgaacgtacggggcctacggtggtcccgtacccagtcgacggttcgaggcgggcgtagggttcggggtcggtaggggaacctacgtaactttccgaaccgtctacccgacctacgtaccgaacgcaccggtccctagggtacctaacggttcgttaacggtaaaaggtttcttttacggtaccgtacggtttaaccttaaacgttcccgttaagttacccgtaaggtaccgttaaaggtttaacgtttaaacgggttaacggttacggggtaaaaccggtttaaaccccggtttaccggggaaaacccggttaaaacgggggaccccctaaaagggtaaaccggtttaggggaaaccggttaaaaaggttaaaacggggtaaacggtttcggggtaacggtaccgtaacggttaaaccccg

SEQ ID NO: 390856 - DNA, 687 bp, Homo sapiens
  misc_feature: GZ8MTXP02I54O8.13.34.D01.1.454.CMB.2.raw
  modified_base (407)..(407): a, c, t, g, unknown or other
  modified_base (450)..(450): a, c, t, g, unknown or other
  modified_base (454)..(454): a, c, t, g, unknown or other
  modified_base (482)..(482): a, c, t, g, unknown or other
tcagtcacgtactacacgaccggtgctcgatttagatcgtctgtgttgggtttggggagagctctgggggaggaactgctcagttaggacccagacggaaccatggaagcccccagcgcagcttctcttcctcctgctactctggcctccagatactactggagaaatagtgctgacgcagtcctccagtccaccctgtctgtgtctaccgaagggaatagacctaaccctctcctgcgagggccagcaggtagtagtagcagcagtcttagccgtggtaaccagacgagacgaccgtcggaccgacggacctcccgaggtccttacctcgtaatttcgtggtacactactaccgacgtacggcctacggtcggtacccgtcccgtaggtcgtaacggtcacggcgngtagggtcgggtcgagggacacgtacctctactctacactacncacncgacgctagcctagtctagtaaacgttntttacgacgttaccgttacgtttaattaccgtgtacggacgttaacttaaaggtttaacgtaacgtttaacggaacggggttaaccgtaaccggttacccggggaaacgttaaaccggggaccgtaaacggtaaccggtaaagggtaaaaggttaaacggttaaaacgggtacggttacggtaccggtaccgttaccgtaaaccg

SEQ ID NO: 390857 - DNA, 609 bp, Homo sapiens
  misc_feature: GZ8MTXP02FIU4F.13.34.D01.1.454.CMB.2.raw
  modified_base (271)..(271): a, c, t, g, unknown or other
  modified_base (404)..(404): a, c, t, g, unknown or other
  modified_base (407)..(407): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggggaaatagcaaccctctcctgcagggccagtcagagtgttagcagcagcttagcctggaccngcagaagcctggccaggctcccaggcctcctcatttatggtgcatcccaactaggggccacgtggtcgtccccagtcaggttcagcgggcaggtggggtctggggacagacttcactctcaccatcagcgacncgngcgagtcgtagaagttagtttcgacgtacgttacttaatttaccgttagtacacgtacgtaagtaacgtttaagttacggtacggtaaaccgttaacccggtttacccgggaaaccgggtaaacgggaacccgaaaccgacgttaacgggaaacgttaaaaggtttaaaaccggaacgttacggtacggtctacggaacccg

SEQ ID NO: 390858 - DNA, 637 bp, Homo sapiens
  misc_feature: GZ8MTXP02F6A76.13.34.D01.1.454.CMB.2.raw
  modified_base (162)..(162): a, c, t, g, unknown or other
  modified_base (251)..(251): a, c, t, g, unknown or other
  modified_base (277)..(277): a, c, t, g, unknown or other
  modified_base (300)..(300): a, c, t, g, unknown or other
  modified_base (314)..(314): a, c, t, g, unknown or other
tcagtcacgtactacacgaccggtgctcgatttagatcgtctgtgttgggtttggggagagctctggggaggaactgctcagttaggacccagacggaaccatggaagccccagcgcagcttctcttcctcctgctactctggcctccagatactactgganaaatagtgctgacgcagtctccagtcaccctgtcctgtgtctacgagggaaatgccaaccctctcctagcagggccatcagtatgtagnagcagtctagcttggacagcaagacnctaggcctagcctcaggctcctntatttagtggtacnctacgtaccgtaacgtcgactggttcgtacccgtccagtacgtacggtcacggcggtacgtgggtcggtacgtacggggactaacgtccttactactaccgtaccaccgtacacgacgaccacgtacgtcgacgtagtacgtaagttaagttcgttaccgtattacgttaagttacgttacacgtacgtaacgtagttaagttaacgttacgttaacgtacggtaaaccgtaccggttacgtaaaccggtaaacggtaccgtaacggtacggtaaggaaacggttaaacgttaacgtaacggtagtcgtaaccggttacgacg

SEQ ID NO: 390859 - DNA, 554 bp, Homo sapiens
  misc_feature: GZ8MTXP01EDNTQ.8.78.H01.1.454.CMB.2.raw
  modified_base (412)..(412): a, c, t, g, unknown or other
  modified_base (528)..(528): a, c, t, g, unknown or other
  modified_base (544)..(544): a, c, t, g, unknown or other
tcagctcgcgtgtccacgaccggtgctcgatttagtgtgagtagtttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcattcgcncttctgatacctcagcatgctcacagcacaccttcacaggcttacagaacgctacccctacccaacaacgcataagcgtcgctgccgcagcttcggtgcattgttagccccgtttncttcttcccgcaatcngagcaacgcg

SEQ ID NO: 390860 - DNA, 588 bp, Homo sapiens
  misc_feature: GZ8MTXP01EJZES.8.78.H01.1.454.CMB.2.raw
  modified_base (342)..(342): a, c, t, g, unknown or other
  modified_base (392)..(392): a, c, t, g, unknown or other
  modified_base (435)..(435): a, c, t, g, unknown or other
  modified_base (529)..(529): a, c, t, g, unknown or other
  modified_base (555)..(555): a, c, t, g, unknown or other
  modified_base (584)..(584): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctcccgtccccccttcgcagtaacaccaagtacagaatattaacctgttcccatcgactacgcctttcggcctcgccttaggggtcactcaccctgccccgattaacgtgacnggaccttggtctcggcgagcgggctttcgacctctttatcgttacttagngtcagcattcgctcttctgactaccctcagcatcgcctcacanccactaccttcacaggacttacgacgaaaccgtcctacccccgtaacccaaacaaccgaccaagtaacgcgtcgctcgccgcacgcttcgggtncgtagttcggttaccgtccccgtttncttccttcccactaactcgagacgtaacncgcg

SEQ ID NO: 390861 - DNA, 595 bp, Homo sapiens
  misc_feature: GZ8MTXP01B4V3F.8.78.H01.1.454.CMB.2.raw
  modified_base (435)..(435): a, c, t, g, unknown or other
  modified_base (437)..(437): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttgcagtaacaccaagtacagaatattaacctgttccatcgactcgcctttcggcctcgccttagggcactcaccctgccccgattaacgtgacaggacccttggtcttccggcgagccgggtcttttcgaccgtctttactcgttacttatgtcagctattcgctcttctgactaccctcagcatcgcctcacncncacaccttcacaggcttaacacgaacgccctaccccgtaacccaaacaaccgacagtaacgcgtacgctcgccgcacgcttcggtgttctacgttcggtttaaccgtccccgtttcacttcccttaaccccgctaacttcgacgacgaaccgaacgcg

SEQ ID NO: 390862 - DNA, 617 bp, Homo sapiens
  misc_feature: GZ8MTXP01AKS61.8.78.H01.1.454.CMB.2.raw
  modified_base (381)..(381): a, c, t, g, unknown or other
  modified_base (405)..(405): a, c, t, g, unknown or other
  modified_base (431)..(431): a, c, t, g, unknown or other
  modified_base (435)..(435): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggcaacatacgccttctccgtcccccttgcagtaacacaagtacagaatattaactgttccatcgactacgccttcggcctcgcttagggcactcaccctgccccgattaacgttggacacggaacccttggtcttccggcgagcgggcttttcgaccgtctttancgttactatgtcagctattcgacncgttctgactacctcagcactgcctnacanccactaccttcacagcttacgaacaccgccaccctaaccaacgaccacaataacgcgtcgactcgacccgcacgtcgttcggtcgttacgtacgttcggttttaaccggtccccgttttattacccgttccctttaacccccggccttaacttacccggtaggaaccgtaaccgcggtccgg

SEQ ID NO: 390863 - DNA, 582 bp, Homo sapiens
  misc_feature: GZ8MTXP02HCBCG.8.78.H01.1.454.CMB.2.raw
  modified_base (387)..(387): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttgacaggaacccttggtcttccggcgagcgggcttttcgacccgctttancgttacttatgtcagcattcgcacttctgactacctccagcatgcctcacagcacaccttcacaggcttacagaaacgctacccctacccaacaacgcaataagctcgctgccgcagcctttcgggcgctacgttcggtttaccgtccccgtttacacttccgttcccgcctactccgtacgacgaccgacggcg

SEQ ID NO: 390864 - DNA, 597 bp, Homo sapiens
  misc_feature: GZ8MTXP02IPZ08.8.78.H01.1.454.CMB.2.raw
  modified_base (411)..(411): a, c, t, g, unknown or other
  modified_base (417)..(417): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcttcggcctcgccttagggcactcaccctgccccgattaacgtggacaggaacccttggtcttccggcgagccgggtcttttcgacccgtactttatcgttacttactgtcagcattcgcnctttcngacttaccctccagcatcgcctcacagcacaccttcacagcttacagaaccgcctcccctaacccaacaaccgcaactaacgcgtcgctcgccgaccgcgtcgtcgtcgtcgtacgttacggtttaccgttcccgttccttaccttccttcccgtcctactcgtacgtacgaccgacgcg

SEQ ID NO: 390865 - DNA, 605 bp, Homo sapiens
  misc_feature: GZ8MTXP02HNONR.8.78.H01.1.454.CMB.2.raw
  modified_base (562)..(562): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgtggacaggaacccttggtcttccggcgagcgggcttttcgacccgctttatcgttacttactgtcagcattcgcacttctgactacctccagcatgccctcacagcacaccttcacaggcttacacgtaaacgcctacccctaccaaacaacgcaataacgccgtcgctacgccacacgtccgttcggtcaccgtaagttcgggtttaaccgtcccccgtttanaaccttccctttccgcgaccctattccgacgaacgaccaccgg

SEQ ID NO: 390866 - DNA, 592 bp, Homo sapiens
  misc_feature: GZ8MTXP02IEU6R.8.78.H01.1.454.CMB.2.raw
  modified_base (387)..(387): a, c, t, g, unknown or other
  modified_base (430)..(430): a, c, t, g, unknown or other
  modified_base (438)..(438): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttctggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtgacaggaaccccttggtcttccggcgagcgggctttcgacccgctttancgttactatgtcagcattcgcacttctgataccctcagcatcnctcacacncacacctcacacgactacacgaaccgacctacccctacccaaccaaccgacactaacgacgtcgcgtcgccgcgacgtcgtcggtcgtcgtacgttacgtttaccgtcccgttcctacctccgttcccgtacctactacgtacgtacgacgacg

SEQ ID NO: 390867 - DNA, 620 bp, Homo sapiens
  misc_feature: GZ8MTXP02GNMXX.8.78.H01.1.454.CMB.2.raw
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgacttaaaccgggacaaccgtcgcccggccaacatacgccttctcccgtcccccttcgcagtaacaccaagtacagaatattaacctgttccatcgactacgccttcggcctcgcttagggcactcaccctgccccgattaacgttgacaggaccctggtcttccggcgagcgggtctttcgaccgtcttatcgttactatgtcagctacttcgactacttctagactaccttccgacgctactcgacctacacgacacctacctactacacgtacgtactaaccgacgaaccctaccctaaccccaaccgaaacaccgactaacgtaacgtccgcgtcgtccgccgacgtacgttcgtcgtcgtacgttcgttacggttaccctcccttactccttccttccgacgtactacgtacgacgtaccgacgacg

SEQ ID NO: 390868 - DNA, 581 bp, Homo sapiens
  misc_feature: GZ8MTXP02HF7RM.8.78.H01.1.454.CMB.2.raw
  modified_base (408)..(408): a, c, t, g, unknown or other
  modified_base (504)..(504): a, c, t, g, unknown or other
  modified_base (516)..(516): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttggacaggacccttggtcttccggcgagcgggctttcacccgctttatcgttactatgtcagcattcgcncttctgatacctccagcatgcctcacagcacacttcacaggcttacagaaaccgcctaccccctaccaaacaacgcataaacgcgtcgctcgccgnagcttcggggtnctacgttcggttaccgtccccgtttacacttcccttccccgcctatcctagacgaccgacggacg

SEQ ID NO: 390869 - DNA, 633 bp, Homo sapiens
  misc_feature: GZ8MTXP02IYFGO.8.78.H01.1.454.CMB.2.raw
  modified_base (359)..(359): a, c, t, g, unknown or other
  modified_base (418)..(418): a, c, t, g, unknown or other
tcagctcgcgtgtccacgaccggtgctcgatttagtgtgagtagtttgggtttggggtacgatttgatgttacctgatgcttaggggctttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgtgacaggaacctggtcttccggngaggccggggcttttcgacccgtacgtttactcgtacttatcgtcagcattcgcacttntgtactacctccagcattcgccctctacacacacctacctactacacgtactacacgaaccgaccctacccctaacccaaccaaccgaccaacgtaacgtaccgtccgtacgtcgccgcgacgtcgttcgtcgtacgtacgttacggttaccgttacccgttaccgttaccttccgttcccgtccgtacgtacgtacgacgtacgacgtacgacg

SEQ ID NO: 390870 - DNA, 581 bp, Homo sapiens
  misc_feature: GZ8MTXP02JX2K8.8.78.H01.1.454.CMB.2.raw
  modified_base (467)..(467): a, c, t, g, unknown or other
  modified_base (521)..(521): a, c, t, g, unknown or other
  modified_base (537)..(537): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgtggacaggacccttggtcttccggcgagcgggcttttcgacccgtctttatcgttacttatgtcagcattcgctcttctgactacctcagcatcgcctcacagcacaccttcacaggcttacacgaaccncctacccctacccaacaacgcaataacgcgtcgctcgcccgcgagtcttcggtnctacgttcggtttacnccccgtttacacttccttaacccgctactcgtagacgacacgcg

SEQ ID NO: 390871 - DNA, 562 bp, Homo sapiens
  misc_feature: GZ8MTXP02IYCUZ.8.78.H01.1.454.CMB.2.raw
  modified_base (381)..(381): a, c, t, g, unknown or other
  modified_base (462)..(462): a, c, t, g, unknown or other
  modified_base (499)..(499): a, c, t, g, unknown or other
  modified_base (509)..(509): a, c, t, g, unknown or other
  modified_base (521)..(521): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttagggcactcaccctgccccgataacgtgacagacccttggtcttcggcgagcgggtcttttcacccgtctttancgttacttactgtcagcattccgcacttctcgactaccctccagcatcgcctcacagcacaccttcacagcttacagaacncctaccccaaccaacacgcataagcgtacgctgccgnacgcttcggncattcggttacnccccgtttacacgttccttcccgcctatcctgacacacgcg

SEQ ID NO: 390872 - DNA, 689 bp, Homo sapiens
  misc_feature: GZ8MTXP02F8VFX.8.78.H01.1.454.CMB.2.raw
  modified_base (368)..(368): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgacttaaaccgggacaaccgtcgcccggccaacatagccttctcccgtccccccttcgcagtaacaccaagtacagaatattaacctgttcccatcgactacgcctttcggcctcgccttaggggtcactcaccctgccccgattacgtgacagacctgctcgcagcggctttcaccgtnttatcgttactatgtcagctattccgctcttctgactaccctccagcatcgccctacacacgccaaccctaccttccaacgtacggtccttaaccaacgaaacccgtccccttaccccctaaaccccaaacaaacccgacaaacgttaaaccggccgttccgaccgtcgacccgaccgaggttccccgtttacggggtctaccgttaaacggtttcggggtttaaccccgtccccccggtttttacaaccctttttcccccgttaacccccggtaccctaagtttaccccgagggtaaaccgaacccggaccggtacccgg

SEQ ID NO: 390873 - DNA, 662 bp, Homo sapiens
  misc_feature: GZ8MTXP02JXBB5.8.78.H01.1.454.CMB.2.raw
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgtttcccatcgactacgcctttcggcctcgccttaggggtcactcaccctgccccgattaacgttggacaggaacccttggtcttccggcgagcgggcttttcacccgtctttatcgttacttatgtcagcattcgcacttctgactacctcacgcatcgccctcacagccacaccttcacaggccttacagaaaccgcctaccccctaacccaacaaaccgcaactaacgccgttacgcctcggccccgacgtacgcccgtttccgggtcggtcctaacggtttaccgggtttttaaaccggtacccccccggtttttcctaacctttcccccgtttcccccggaccctaaccgtttcccttaggaccgtaaccgacccggaccgg

SEQ ID NO: 390874 - DNA, 585 bp, Homo sapiens
  misc_feature: GZ8MTXP02HM76A.8.78.H01.1.454.CMB.2.raw
  modified_base (180)..(180): a, c, t, g, unknown or other
  modified_base (417)..(417): a, c, t, g, unknown or other
  modified_base (442)..(442): a, c, t, g, unknown or other
  modified_base (446)..(446): a, c, t, g, unknown or other
  modified_base (464)..(464): a, c, t, g, unknown or other
  modified_base (481)..(481): a, c, t, g, unknown or other
tcagctcgcgtgtccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctccgtccccccttcgcagtaacaccaagtacagaatattaacctgtttccatcgactacgcctttcgcctcgccttaggggtcactcaccctcgccccgattaacgttggacaggaacccttggtcttccggcgagcgggtcttttcacccgtctttatcgttacttatgtcagctattcgcacttcngactacctcagcatcgcctcagacncacnctcacacgctacacaccncctacccaaccaacacncaagtacgcgtcgctcgccgacgacgtcgtcgtcgtcgtacgttcggttaccgttcccgttacctaccttcccgttcccgtacctactctacgacgacgacgcg

SEQ ID NO: 390875 - DNA, 584 bp, Homo sapiens
  misc_feature: GZ8MTXP01A5BBI.22.69.G03.1.454.CMB.2.raw
  modified_base (358)..(358): a, c, t, g, unknown or other
  modified_base (581)..(581): a, c, t, g, unknown or other
  modified_base (583)..(583): a, c, t, g, unknown or other
tcagacatacgcgtcacgaccggtgctcgatttagtcgctgcgtaaaggagaaaggggagacttggtacagcctgggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaaggccgttcaccctctccagagacaattccaagaatacggtgtatctgcaaatgaacagcctgagagccgaggacacggcgtatattactgtgcgaatcaaaagttcggggactcgattcgatatggacgtcgnggggcaaggggaccacggtcacccgtctcctcacgccctccaaccgaacgggccccatccggtccttcccccgtggccgccctcgcctcccgaggacgccacctccgagacgggcaccgacgccggcccgtcgggcctcgcccgtggtacgaacggtacctaccgttcccaacggttcgttagttcgtctgacggcgggcgtgggccgaagggccgacgatgngng

SEQ ID NO: 390876 - DNA, 570 bp, Homo sapiens
  misc_feature: GZ8MTXP01ECB0Y.22.69.G03.1.454.CMB.2.raw
  modified_base (565)..(565): a, c, t, g, unknown or other
  modified_base (569)..(570): a, c, t, g, unknown or other
tcagacatacgcgtcacgaccggtgctcgatttagtcgctgcgtaaaggagaaagggggagacttggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccgttcaccctctccagagacaattccaaagaatacggtgtatctgacaaatgaacagcctgagagccgaggacacggccgtatattactgtgcgaaatcaaaagttcggggactccgattcgatatggacgtcgtggggacaaggggacccacggtccacccgtctccctcacgccctcccgaccaaacggggccccagttccggtcccttccccccgtggcccgccccttcgcctcccgaggacgccaacctccgagacggcacgacgccggccctgggctgcctggtcaaggctctccacgcgtattgtctgagcgggctggccaaggcganatgnn

SEQ ID NO: 390877 - DNA, 595 bp, Homo sapiens
  misc_feature: GZ8MTXP01DUXPN.22.69.G03.1.454.CMB.2.raw
  modified_base (148)..(148): a, c, t, g, unknown or other
  modified_base (244)..(244): a, c, t, g, unknown or other
  modified_base (271)..(271): a, c, t, g, unknown or other
  modified_base (443)..(443): a, c, t, g, unknown or other
  modified_base (450)..(450): a, c, t, g, unknown or other
  modified_base (470)..(470): a, c, t, g, unknown or other
  modified_base (593)..(593): a, c, t, g, unknown or other
  modified_base (595)..(595): a, c, t, g, unknown or other
tcagacatacgcgtcacgaccggtgctcgatttagtcgctgcgtaaaggagaaagggggagacttggtacagcctgggggggtccctgagactctcctgtgtaacctctggattcaccttttaggagctatgccatgatgtgggtccnccaggctccgagggaaggggctggagtgggtgtcaacgattagtggaagtggtactggtatatactacgcagactccgtgaagggccgttcacctntccagagacaattccaagaatacggtntatctgacaaatgaacagcctgagagccgagacacggctatatactgtgacgaatacgaaaaggttcgggactcgattcgatagtggacgtccgtggggaccaaggacccacggtccacccgtctcctcacgccctacccaccgacgggcccacgtccgtcccttcccccgnggtcccncccgtgccctccgacggacnccaccgccgacgacgcacgacgtccggcccgtgggctcgccgtggtccaaacggtccttacctcccgaacgttcgttattcgtcgtcggaggttcggacgtggacgaacggcggcttaggtgngn

SEQ ID NO: 390878 - DNA, 539 bp, Homo sapiens
  misc_feature: GZ8MTXP02ICONV.22.69.G03.1.454.CMB.2.raw
  modified_base (241)..(241): a, c, t, g, unknown or other
  modified_base (267)..(267): a, c, t, g, unknown or other
  modified_base (428)..(428): a, c, t, g, unknown or other
  modified_base (538)..(539): a, c, t, g, unknown or other
tcagacatacgcgtcacgaccggtgctcgatttagtcgctgcgtaaaggagaaagggggagacttggtacagcctggggggtccctgagactctcctgtgtaacctctggattcacctttaggagctatgccatgatgtgggtccgccaggctccagggaagggctggagtgggtgtcaacgattagtggaagtggtactggtatatactacgcagactccgtgaagggccgttcaccctntccagagacaattccaagatacggtntatctgcaaatgaacagcctgagagccgaggacacggccgtatattactgtgcgaatcaaaagttcgggacgtcgattcgatatggacgtctggggccaagggaccacggtccaccgtctcctcagccctccaccaagggcccatcggcttccccctggcnccctgcctccacggacgcacctccgacgagccacacgcggccctgggcctgcctggtcaaggctacttccacgctactgctcgacgcgggctggcaacggcgacactagnn

SEQ ID NO: 390879 - DNA, 533 bp, Homo sapiens
  misc_feature: GZ8MTXP02I8DRF.22.69.G03.1.454.CMB.2.raw
  modified_base (532)..(533): a, c, t, g, unknown or other
tcagacatacgcgtcacgaccggtgctcgatttagtcgctgcgtaaaggagaaagggggagacttggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcggggacgtccgattcgatatggacgtcctggggccaagggaccacggtcaccgtctcctcagccctccacaagggcccatcggtcttcccctggcgccctgcctccagagcacctccgagagcacagcggccctgggctgcctggtcaaggactacttccacgcgtatgtctgagcgggctggcaaggcgcatagnn

SEQ ID NO: 390880 - DNA, 586 bp, Homo sapiens
  misc_feature: GZ8MTXP02JQOVU.22.69.G03.1.454.CMB.2.raw
  modified_base (585)..(586): a, c, t, g, unknown or other
tcagacatacgcgtcacgaccggtgctcgatttagtcgctgcgtaaaggagaaagggggagacttggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccgttcaccctctccagagacaattccaagaatacggtgtatctgcaaatgaacagcctgagagccgaggacacggccgtatattactgtgcgaatcaaaagttcggggactccgattcgatatggacgtccgtggggccaagggaccacggtccaccgtctcctcacgccctccaccgaacgggccccagtccggtccttcccccgtggcccgcccctgcctccgaggacgccacctccgagacgccacgacgccgggcccctgggcctcgcccgtggtaccgaaacgggacttaccgttcccgacgtcgtactcggtctcgacggcgggctgggacgaacgggcgacagtagnn

SEQ ID NO: 390881 - DNA, 540 bp, Homo sapiens
  misc_feature: GZ8MTXP02JX9ZT.22.69.G03.1.454.CMB.2.raw
  modified_base (241)..(241): a, c, t, g, unknown or other
  modified_base (534)..(534): a, c, t, g, unknown or other
  modified_base (536)..(536): a, c, t, g, unknown or other
  modified_base (539)..(540): a, c, t, g, unknown or other
tcagacatacgcgtcacgaccggtgctcgatttagtcgctgcgtaaaggagaaagggggagacttggtacagcctgggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccgttcaccctntccagagacaattccaagaatacggtgtatctgcaaatgaacagcctgagagccgaggacacggccgtatattactgtgcgaatcaaaagttcggggactcgattcgatatggacgtctggggccaaggggaccacggtcaccgtctcctcagcctccaccaagggccccatccggtccttccccctggccgccctgctcccaggacgccacctccgagacgcacagcggccctgggcctgcctggtcaaggctactccacgcgtactgtctgacgcgggctggcaaggcgananagnn

SEQ ID NO: 390882 - DNA, 600 bp, Homo sapiens
  misc_feature: GZ8MTXP02I5MBA.22.69.G03.1.454.CMB.2.raw
  modified_base (146)..(146): a, c, t, g, unknown or other
  modified_base (442)..(442): a, c, t, g, unknown or other
  modified_base (465)..(465): a, c, t, g, unknown or other
  modified_base (600)..(600): a, c, t, g, unknown or other
tcagacatacgcgtcacgaccggtgctcgatttagtcgctgcgtaaaggagaaagggggagacttggtacagcctggggggtccctgagactctcctgtgtaacctctggattcacctttaggagctatgccatgatgtgggtccnccaggctccgagggaaggggctggagtgggtgtcaacgattaggtggaagtggtactggtatatactacgcagactccgtgaagggccgttcaccctctccagagacaattccaaagaatacggtgtatctgacaaatgaaacagcctgagagccgaggacacggccgtatattactgtgcgaaatcaaaaaggttcggggactccgattcgatatggactcgtggggccaagggaccacggtcacccgtctcctcagccctccaccgaacgggcccagtccggtccttcccccgngcccgccctcgcctccgaggacnccaccgtccggacgacgccaacgcggccggcccgtcgggcctcggcccgtggtccaaacgggtacccttacttccgaacggtcgtacgttcgtacgtggacggtcgggcgtcgggacgaacgggcacgatacgcn

SEQ ID NO: 390883 - DNA, 572 bp, Homo sapiens
  misc_feature: GZ8MTXP01D7K4F.41.5.A05.1.454.CMB.2.raw
  modified_base (296)..(296): a, c, t, g, unknown or other
  modified_base (317)..(317): a, c, t, g, unknown or other
  modified_base (427)..(427): a, c, t, g, unknown or other
tcagtctatactatcacgaccggtgctcgatttagatagatagacagggggggtctcaggaggcagcgctctcaggacgtcaccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaacacgacccccaaatcattattangcgtcaatgtcgccttcggtntccctgacgcgtcttctcgtcgggtccccaagtctggccaaacgaccggccctccctgaccctatcctcgtcgggctccgaggctggaggacgaggctagtattattacngcagtctacagtatacgaagtcggaactactttactattcggcgtacgaacgggaccaagtcgtgacccgtccgttaggtaccacggcccgaaggcctcccgcccccgttcgggtccctacgttccgtccgtttcccccgtcccc

SEQ ID NO: 390884 - DNA, 547 bp, Homo sapiens
  misc_feature: GZ8MTXP01BR2YY.41.5.A05.1.454.CMB.2.raw
  modified_base (218)..(218): a, c, t, g, unknown or other
  modified_base (296)..(296): a, c, t, g, unknown or other
  modified_base (312)..(312): a, c, t, g, unknown or other
  modified_base (431)..(431): a, c, t, g, unknown or other
  modified_base (486)..(486): a, c, t, g, unknown or other
  modified_base (514)..(514): a, c, t, g, unknown or other
tcagtctatactatcacgaccggtgctcgatttagatagatagacaggggagctctgggagaagagccccagccccagaattcccaggagtttccactcggtgatcagcactgaacacagaggactcaccatggagtttgggctgagcttgggttttccttgctattattataaaaggtgtcctgtgtcaggtacagatggcggagtcgtgggggaanaacggtcaacccgtggcggtcctgaggctctcctgttagtctggattcgcttcagcgactacacctgagttgggccgntggctccgagggaagngtctggagtggattgcgtacatcagtcattctgacttcgacgtctactacgcagctctggtgggacgggccgattcaacctatttccgagggaccgacgccgacgaaactctactttanctgcagatggactagtctagacgacccgaagacgacggcctatatatacgtgtgngcgaggtagttaagttggttcgttccgnggggcccggaaccgtggtccaccgtcgttccgc

SEQ ID NO: 390885 - DNA, 601 bp, Homo sapiens
  misc_feature: GZ8MTXP01AJBIT.41.5.A05.1.454.CMB.2.raw
  modified_base (247)..(247): a, c, t, g, unknown or other
tcagtctatactatcacgaccggtgctcgatttagatagatagacaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgactattggtgttaataactntgtctcctggtaccaacacacccaggcaaacgccccaaatcatgattcatgatgtacaagtactcggcccttacgtaggggtttctggttccgtctttccgtcgtggcctaccgaagtcgtcggccaaccgaccgggtccctcccctagacctatctcgtgggcctccgaggctggaggacgaggctagacttatactgactagctacaataaacgtaaaagacgacctaaactacgttagttaacgtaggttcgggaacggaacgggaacccaaagccgtacgtaacccgttcgttaggaccaaccggcccgaaacggtcccgtaccgttcccccgtcggttcccgtaacccg

SEQ ID NO: 390886 - DNA, 531 bp, Homo sapiens
  misc_feature: GZ8MTXP02GPOJT.41.5.A05.1.454.CMB.2.raw
  modified_base (313)..(313): a, c, t, g, unknown or other
tcagtctatactatcacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggtctggattcgtcttcagcgactactacctgagttgggccgctggctccgagggangtctggagtggattgcgtacatcagtcattctgattcgaccgtctactacgcagctctggtggaggccgatttcaccatttccaggacgacgccgcgaactcacttatctgcagatgactagtctgacgacccgagacacggccatatattactgtgtgcgaggagttaactggtgtccgtgggggtccccggaaccgtcggtccgaccgtctccgcg

SEQ ID NO: 390887 - DNA, 524 bp, Homo sapiens
  misc_feature: GZ8MTXP02FIWOX.41.5.A05.1.454.CMB.2.raw
  modified_base (298)..(298): a, c, t, g, unknown or other
  modified_base (321)..(321): a, c, t, g, unknown or other
tcagtctatactatcacgaccggtgctcgatttagatagatagacagggggggtctcaggaggcagcgctctcaggacgtcaccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacacgcccccaaactcattatttangcgtcaatgttcgcccttcggtntccctgagcgcttctctggtccccaagtctggcaacacggcctcctgaccatcctctgggctccagctgaggacgagctgattatactgacagctcatatacaagtagggaactactttactagttcggcgacgagggtacaagctagaccgtcctacggcacgacccaaggcctcgcccctcggtcactctcgttcccgccc

SEQ ID NO: 390888 - DNA, 529 bp, Homo sapiens
  misc_feature: GZ8MTXP02H8882.41.5.A05.1.454.CMB.2.raw
  modified_base (316)..(316): a, c, t, g, unknown or other
  modified_base (348)..(348): a, c, t, g, unknown or other
  modified_base (361)..(361): a, c, t, g, unknown or other
  modified_base (421)..(421): a, c, t, g, unknown or other
tcagtctatactatcacgaccggtgctcgatttagatagatagacaggggagctctgggagaagagcccccagccccagaattcccaggagtttccactcggtgatcagcactgaacacagaggactcaccatggagtttgggctgagctgggtttccttgctattattataaaaggtgtcctgtgtcaggtacagatgggcggagtcgtgggggaagaacggtcaaccctggcgggtccctgaggctctcctgttaggttctggattcgtcttcagcgactactacctgagttgggccgctggctccgagggaangtctggagtggattgcgtacatcagtcattcngacttcgaccgtntactacgcagctctgtggagccgatcacattccaggacgacgccgcgaactcactttacnctgcagatgactagtctgacgacccgaagacacggacatatatactgtgtgcgaggtagttacgtggtgtccgtcggggcccggaaccgtcggccgaccgtctccgcg

SEQ ID NO: 390889 - DNA, 711 bp, Homo sapiens
  misc_feature: GZ8MTXP02HTVMP.41.5.A05.1.454.CMB.2.raw
tcagtctatactatcacgaccggtgctcgatttagatagatagacagggggggtctcaggaggcagcgctctcaggacgtcaccaccatggcctgggctctgctcctcctcaccctcctcactcagggcacaggatcctgggctcagtctgccctggctcagcctccctccgtgtccgggtctcctggacagtcagtcaccatctctgcactggaaaccaacagtgacgtcggttcgttttgaccgtgtcctctggaccagcagaccccagaaacacgacccccaaatctattatttatgcggtcaattgttccgtcccgtttccggtcgttccctggacgtcgtcctttcgtcgtcggggtaccccaaggttcctggacctaaacgacccggtcccttccccgtagaacccctagttccccgttcgtcggggcccttcccgacgggtaccgtacgggaacgggaaccggacggtccgttaggtaaacttttacttaaccgtggaccacggtccttactaaactttaaagttaaaccgaaagggttacgggggaaacctttaaccgttttaacgtaacggtttccgggaccgacggtaaaccggggaactaaacggtcctacggtacccgttacccgtaggtaccacgacccgtaaggccctccggtcccccgtacggttccacctttcccgtccggtttacccctccccg

SEQ ID NO: 390890 - DNA, 554 bp, Homo sapiens
  misc_feature: GZ8MTXP02IUUGM.41.5.A05.1.454.CMB.2.raw
  modified_base (311)..(311): a, c, t, g, unknown or other
tcagtctatactatcacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcggtcctgagctctctgttagtctggattcgtcttcagcgactactacctgagttgggccgctggctccgagggaagngtctggagtggattggcgtacatcagtcattctgtacttccgaccgtctactacgcagctcgtggtgggacggtcccgatttccacctactttccgagggaccgacgccgacgactcctactttatctgcagatgactgtctagacgacccgagacacgaccatatattactgtgtgcgtaggtacgttacgttggtcgtccggtcggggccccggtaaccgtcggtacctaccgtctccgcg

SEQ ID NO: 390891 - DNA, 589 bp, Homo sapiens
  misc_feature: GZ8MTXP02GJYWY.41.5.A05.1.454.CMB.2.raw
  modified_base (261)..(261): a, c, t, g, unknown or other
  modified_base (291)..(291): a, c, t, g, unknown or other
tcagtctatactatcacgaccggtgctcgatttagatagatagacagggggggtctcaggaggcagcgctctcaggacgtcaccaccatggcctgggctctgctcctcctcaccctcctcactcaggacacagggtcctgggcccagtctgccctgactcagccctccctccgcgtccgggtctgtcggtcagtcagtcaccatctcctgcactggaaccagctaatttcattggtaatcatgactatgtctctggtacancatccacccagcacacgccccagactcgtntattttgagtacaatacgccgccctcgacggggtcccgtagtccgttctccgtggcctcagtctcgaccacgaccggccctacccgtcgacccgtctccgtcgggcctccgacggtcctggaacgtgtagacgggtcttagtactttagttacgtcgacacgtcgtaccgagtacgggacgacctaccgtattgttatttcggtcgtttcgggacgggtacggaccgaggtaccgtcggacccgtacgtacgtccgaccgccgtacgccgtcccggcccctcggtacctcgtttcccg

SEQ ID NO: 390892 - DNA, 555 bp, Homo sapiens
  misc_feature: GZ8MTXP02GZQOI.41.5.A05.1.454.CMB.2.raw
  modified_base (300)..(300): a, c, t, g, unknown or other
  modified_base (314)..(314): a, c, t, g, unknown or other
  modified_base (318)..(318): a, c, t, g, unknown or other
  modified_base (427)..(427): a, c, t, g, unknown or other
  modified_base (434)..(434): a, c, t, g, unknown or other
tcagtctatactatcacgaccggtgctcgatttagatagatagacaggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaacccgtggcgggtccctgaggctctcctgtttaggtctggattcgtcttcagcgactactacctgagttggccgntggctccgagggangtcnggatggattggcgtacatcagtcattctgacttcgaccgtctactacgcagctctggtgggaggccgattccacctattccgaggaccgacgccgcgaactcactttanctgcagntgactgtctgacgacccgaagacacggccatatattacgtgtgtgacgaggtacgtttaacgtgggtacgtccggtgggggacccccggtaaccgtcggtcctacccggtcgtcccgaccg

SEQ ID NO: 390893 - DNA, 601 bp, Homo sapiens
  misc_feature: GZ8MTXP02HQCDH.41.5.A05.1.454.CMB.2.raw
  modified_base (268)..(268): a, c, t, g, unknown or other
  modified_base (309)..(309): a, c, t, g, unknown or other
  modified_base (330)..(330): a, c, t, g, unknown or other
tcagtctatactatcacgaccggtgctcgatttagatagatagacagggggagctctgggagaagagccccagccccagaattcccaggagtttccactcggtgatcagcactgaacacagaggactcaccatggagtttgggctgagctgggtttcctgctattattataaaggtgtcctgtgtcaggtacagatggcggagtcgtgggggaagaacggtcaacccgtggcgggtcctgaggctctcctgttggttctggattcgtnttcagcgactactactgagttgggccgctggctcgaggganagtctggagtggattgcgtanatcagtcagttctgtacttccgaccgttctaactacgccagtctcgtggtggggacgggccgtattccacctattccgagggacgacgccgacgaactctactttactctgcagtatagacttagtccgtagacgaaccgaacgacgaccggccaataatagttacctagtgttacggacgtaagggtagttaacgttgggtcggttcccggttaacgggggacccccgggtaaccgttcgggtacccgtacccggtccgttaccggcccg

SEQ ID NO: 390894 - DNA, 602 bp, Homo sapiens
  misc_feature: GZ8MTXP02IP9Y6.41.5.A05.1.454.CMB.2.raw
tcagtctatactatcacgaccggtgctcgatttagatagatagacaggggagctctgggagaagagcccccagccccagaattcccaggagtttccactcggtgatcagcactgaacacagaggactcaccatggagtttgggctgagctgggttttccttgctattatataaaaggtgtcctgtgtcaggtacagatggcggagtcgtgggggaagaacggtcaaccctggcgggtccctgaggctctccttgtttaggttctggtattcgtcttcagcgactactacctgagttggtccggctggctccgagggagagtctggagtggattgcgtacatcagtcattctgtacttcgaccgtctactacgcacgctctgtcgggacggccgtattccactacttcgacggacgacgccgacgaactctactttatctagcgatagtagacttagtcgtacgaacggaacccgaaggaaccgacggaccaattaactattaacgtgtggtacgcggtaaggtacgtttaacggttcggtcggttccggtcgggggcccccgggtaaccggttcggtaccgtacccgtcccgtccgtacccg

SEQ ID NO: 390895 - DNA, 601 bp, Homo sapiens
  misc_feature: GZ8MTXP02HWVR0.41.5.A05.1.454.CMB.2.raw
  modified_base (325)..(325): a, c, t, g, unknown or other
  modified_base (339)..(339): a, c, t, g, unknown or other
  modified_base (347)..(347): a, c, t, g, unknown or other
  modified_base (372)..(372): a, c, t, g, unknown or other
tcagtctatactatcacgaccggtgctcgatttagatagatagacagggggagctctgggagaagagcccccagccccagaattcccaggagtttccactcggtgatcagcactgaacacagaggactcaccatggagtttgggctgagctgggttttcctgctattattataaaggtgtcctgtgtcaggtacagatgggcggagtcgtgggggaagaacggtcaacccgtggccgggtccctgaggctctccgtgtttaggtctggattcgtcttcgagcgactacctactggaggtttcgggccgctggctccgagggaagngtcgtggagtggtnttgcgtanatcagtcattctgacttcgaccgtntactacggcagcgtctaggtggacggggtacctagtttaccacccgtactttacccggacggggaccgaccggacccggtcgtaaacctcctacttttagcctgactagatgtactagtctacggacgtaacccgagaccgacggactaatattattactggtgtgacgtagtagttacgtggtcgtcggtccggggacccggtaccgtcggacctcccgtactccgcg

SEQ ID NO: 390896 - DNA, 563 bp, Homo sapiens
  misc_feature: GZ8MTXP01D9G76.17.75.G09.1.454.CMB.2.raw
  modified_base (380)..(380): a, c, t, g, unknown or other
  modified_base (530)..(530): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactaagtgtgtccccaggggggacagtcattctcacctgtgcctccagcactggagaagtgaccagcggccactatccctatggttccaggtgaagtctggccaggcccccaggacactaattatgatgcgaccaacagacactcctggcgcctggccgttttcgggctccctccgtcgggggcaaacgctgccctgacccgtaaacgggggcncgagcctgaggacgaggccgactattatgcctactatctattgatggtggtcgtctcgtccctagtttcgggcggtcgggaccgaggggtcggccgtccgtcgggtcacgcccaaggcctcgcccccttcggtccacgtctcgttccccncccttccctcctacgtctacgcttcgcgcggcg

SEQ ID NO: 390897 - DNA, 562 bp, Homo sapiens
  misc_feature: GZ8MTXP01BNXBL.17.75.G09.1.454.CMB.2.raw
  modified_base (557)..(557): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcgccactatccctactggttccaggtgaagtctggccaggcccccaggacactaatttatgatgcgaccaacagacactcctgggcgcctggtccgttttcgggctcccgtcgtcgggggccaaagctgccctgaacccgtaacgggggcgcaggccctgacggacgagggccgactattattgcctactatctatttgagtggtgtcgtctcgtcccgtagttttcgggcggtcgggaccgagggtcggccgtccgtcgggtccacgcccaggctcgcccctcggttcacgtcttcgttcccaccctcctctcgtctacgctgngtcgg

SEQ ID NO: 390898 - DNA, 587 bp, Homo sapiens
  misc_feature: GZ8MTXP01DZ2ZX.17.75.G09.1.454.CMB.2.raw
  modified_base (166)..(166): a, c, t, g, unknown or other
  modified_base (223)..(223): a, c, t, g, unknown or other
  modified_base (322)..(322): a, c, t, g, unknown or other
  modified_base (392)..(392): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtgtccccgaggggggacagtcattctcacctgtgcctccagcactgganaagtgaccagcggccactatccctatggttccaggtgaagtctggccacggcccccaggacactaatttatgatgcgaccaacagacactccgtgggcncccgttggtccgtttttcggcctcccgtcgtcgggggccaaaggctcgccccttacccgaaacgggggcncgagccgtggacggacggagggccgacttattatgacctactatctaatttgtagtggtgtcgtctcgtccctaggttttcgggcgggcgggaccgagggtcggccgtcgtcgggtcacgcccgaaggctcgcccccttcggtcttactccgtccgttccccgcccttcctcctgtcctacgccttgcgcgggcg

SEQ ID NO: 390899 - DNA, 630 bp, Homo sapiens
  misc_feature: GZ8MTXP01D2ZOY.17.75.G09.1.454.CMB.2.raw
  modified_base (260)..(260): a, c, t, g, unknown or other
  modified_base (295)..(295): a, c, t, g, unknown or other
  modified_base (298)..(298): a, c, t, g, unknown or other
  modified_base (308)..(308): a, c, t, g, unknown or other
  modified_base (450)..(450): a, c, t, g, unknown or other
  modified_base (459)..(459): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagactgtagaagtagcacgcggccgactactcctacctagtcgtacgnggtagatcgcgacgcccgaccgagactaacttatnatncgaccaacanacgacactcggcggcctcggtcggtttccggttcgccctcccgtccggggtcggaacacgtcgcccgtccgtacccgtaaacccggggacgggccgacgccgtcgaggacggacggacggacctattatttgctacttactntacttgtanggtggtcgtctgccctacgtttcgggtcgggcgggaccgagggtgggtccgtcccgttcgggtgacgcccgaaccggcgtccgtcccccgttcccggtcgttacctcgtttccgttcccgacccccttccctccgttacgtaactcccgtcgttcgtaaggccggggtccg

SEQ ID NO: 390900 - DNA, 567 bp, Homo sapiens
  misc_feature: GZ8MTXP01CRYCP.17.75.G09.1.454.CMB.2.raw
  modified_base (166)..(166): a, c, t, g, unknown or other
  modified_base (292)..(292): a, c, t, g, unknown or other
  modified_base (380)..(380): a, c, t, g, unknown or other
  modified_base (462)..(462): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtgtccccgaggggggacagtcattctcacctgtgcctccagcactggagaagtgaccagcgccactatccctactggtccaggtgaagtctggccaggcccccaggacactaatttangatgcgaccaacagacactcctgggcgcctggccgttttcgggctccctctcggggccaaagctgccctgaaccccgtaacgggggcncgagcctgacggacgaggccgactatatgctactatctatttgagtggtgtcgtctgccgtagtttcggcggtcgggaccgngggtcggccgttccgtggggtccacggcccgaagggcctcggcccccgtcggttcctacctcgttcgttcccgcccttcctcctaacgtctacgctcgcgtcggg

SEQ ID NO: 390901 - DNA, 552 bp, Homo sapiens
  misc_feature: GZ8MTXP01DHGOA.17.75.G09.1.454.CMB.2.raw
  modified_base (318)..(318): a, c, t, g, unknown or other
  modified_base (467)..(467): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccaggggggacagtcattctcacctgtgcctccagcactggagaagtgaccagcggccactatccctatggttccaggtgaagtctggccaggcccccaggacactaatttatgatgcgacaacagacactctgggcncctggccgttttcggcctccctccgtcgggggccaagctgccctgaaccccgtaacgggggcgcagccctgacggacgaggccgactattattgcctatatctatttgatggtcgtcgtctgtcccgtagttttcggcggcgggaccgngggtcggccgtcgtgggtcacgcccaaggctcgcccctcggttcactcttcgttcccgccctcctcctgtctacgctgcgtcggg

SEQ ID NO: 390902 - DNA, 582 bp, Homo sapiens
  misc_feature: GZ8MTXP01B2A05.17.75.G09.1.454.CMB.2.raw
  modified_base (295)..(295): a, c, t, g, unknown or other
  modified_base (324)..(324): a, c, t, g, unknown or other
  modified_base (484)..(484): a, c, t, g, unknown or other
  modified_base (575)..(575): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatccctactggttccaggtgaagtctggccacggcccccaggacaactaatttangatgcgaccaacagacactccgtgggccnccgtcggtccgttttcggccttcccgtccgtcgggggccaaagctgcccctggaacccgtaacgggggcgcagcccgtggagggacgaggccgactattatcgcctactatctattgtagtggtgtcgtctcgcccgtagttttcggcggtcgggaccgngggtcggccggtccgtgggtcacgcccgaagcgtcgccccgtcgttccgacgtcttcgttcccaccctcctcctaacgtccacgttctcgngtccggg

SEQ ID NO: 390903 - DNA, 539 bp, Homo sapiens
  misc_feature: GZ8MTXP01EURVV.17.75.G09.1.454.CMB.2.raw
  modified_base (223)..(223): a, c, t, g, unknown or other
  modified_base (376)..(376): a, c, t, g, unknown or other
  modified_base (455)..(455): a, c, t, g, unknown or other
  modified_base (499)..(499): a, c, t, g, unknown or other
  modified_base (513)..(513): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccaggggggacagtcattctcacctgtgcctccagcactgganaagtgaccagcgccactatccctatggttccaggtgaagtctggccaggcccccaggacactaattatgatgcgaccaacagacactcctgggcgcctggtccgttttcggctccctcgtcggggccaaagctgccctgaaccctacggggcncagcctgaggcgaggccgactatatgctatatcatttgatggtgtcgtctcgccgtagttttcgggcggcgggaccggngggtcggtccgtcgtcggtcacgccgagctccgcccgtcgttcnctcttccgttcccnccctcctctcgtctcgcgtcgcggcg

SEQ ID NO: 390904 - DNA, 593 bp, Homo sapiens
  misc_feature: GZ8MTXP01D3RWY.17.75.G09.1.454.CMB.2.raw
  modified_base (301)..(301): a, c, t, g, unknown or other
  modified_base (322)..(322): a, c, t, g, unknown or other
  modified_base (326)..(326): a, c, t, g, unknown or other
  modified_base (511)..(511): a, c, t, g, unknown or other
  modified_base (541)..(541): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattccaggctgtggtgactcaggaaccctcactgagtgtgtccccgagggggacagtcattctcacctgtgcctccagcactggagaagtgaccagcggccactactccctacgtggttccgaggtgaagtcgtggccgacggccccaggacactaatttttttangatgcgacaacagacactcgnggcnccgtggtccgttttcggcctcccgtccgtcggggccaacggctcgcccgtcgaacccgtaacggggcgcgacgccgtgacggacggaggaccgactattattcgctactatactattgtagtggtcgtcgtctcgtccgtacgtttcggcggtcgggacgtcgggtcggtccgtccgtcgggtcncggccctagggctccggcccctcggttacnccgttcttccgttccccgccctcctacctcgttcacgttcgtcggcgccggg

SEQ ID NO: 390905 - DNA, 596 bp, Homo sapiens
  misc_feature: GZ8MTXP01DPRIP.17.75.G09.1.454.CMB.2.raw
  modified_base (289)..(289): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatccctatggttccaggtgagtctggccacggccccagacactaattangatgcgacaacagacactcgtggcgcctggtccgttttcggcctcccgtcgtcggggaccaacgctcgccctcgaaacccgtacggggcgcgacgccgtggacgggacgacgggacccgacttaagttacgtcgtaccttacttatctatttgtagtgggttcgtcgtctcgtccgttagtttcgggcgggcgggacgcgggtcggccggtcgtcgggtccacgcccgaggccgtccgccccgtcggttcctaccgtcttccgttccccaccccttcctcctaacgtcctacgctcggcggtccggg

SEQ ID NO: 390906 - DNA, 674 bp, Homo sapiens
  misc_feature: GZ8MTXP01D46QE.17.75.G09.1.454.CMB.2.raw
  modified_base (298)..(298): a, c, t, g, unknown or other
  modified_base (321)..(321): a, c, t, g, unknown or other
  modified_base (327)..(327): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactactccctactggttccaggtgaagtcgtcggccacggcccccaggacacttaatttangatgacgaccaacagacactcgngggccnccgtcggtccgttttcggccttcccgtccgtcggggaccaaacgctcgcccctacggaaaccccgtaacgggggccgcgacgcccgtggacgggacggacgggacccgtaacttagtttacgttcgaccttaacttattactagtttgagttggtgttcgtcgtcgtcccggtagttttccgggcgggtacgggccggtacggggtcggtcccggttccgtcgggtccgaccggcccgaacgggtcccgtccggcccccgtccgggttcctaccgttcccgttcccgttccccgttcccccgttcccttcccgttccgtccgtaccggccgttcggcgggtccgggg

SEQ ID NO: 390907 - DNA, 572 bp, Homo sapiens
  misc_feature: GZ8MTXP01BOV6N.17.75.G09.1.454.CMB.2.raw
  modified_base (565)..(565): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccaggggggacagtcattctcacctgtgcctccagcactggagaagtgaccagcggccactatccctactggttccaggtgaagtctggccaggcccccaggacactaatttatgatgcgaccaacagacactcctgggcgcccgtggtccgtttttcggctccctcgtcgggggccaagctgccctgaaccccgtaacgggggcgcagcctggacgggacgagggcccgactattattcgcctactatctatttgatggtgtcgtcgtcgcccgtagttttcgggcgggcgggaccgagggtcggccgtccgtcgggtcacgcccgaaggctcgccccgtcggttccacgtcttcgttccccaccctcctcctcgtctcgctgngtccggg

SEQ ID NO: 390908 - DNA, 583 bp, Homo sapiens
  misc_feature: GZ8MTXP01ED3RZ.17.75.G09.1.454.CMB.2.raw
  modified_base (549)..(549): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgccccagggtccaattcccaggctgtggtgactcaggaaccctcactaagtgtgtccccaggggggacagtcattctcacctgtgcctccagcactggagaagtgaccagcggccactatccctatggttccaggtgaagtctggccaggcccccaggacactaaattatgatgcgaccaaacagacactcctgggcgcctgggtcccgtttttcgggcttccctccgtcgggggcaaacgctgccctgaccctaaacgggggcgcagccctgaggacgaggcgactattattgctactatcatttgatggtgtcgtctgtcccctagtttcgggcgggtccgggaccgaggggtcggcccggttccgtcggggtctacggcccaaacgggcctcggccccgttcgggtccacgtctcgttccccncccttcctcctacgtctacgcttgcgttcgggcg

SEQ ID NO: 390909 - DNA, 556 bp, Homo sapiens
  misc_feature: GZ8MTXP01EH8HG.17.75.G09.1.454.CMB.2.raw
  modified_base (386)..(386): a, c, t, g, unknown or other
  modified_base (525)..(525): a, c, t, g, unknown or other
  modified_base (550)..(550): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcgccactatccctatggttccaggtgaagtctggccaggcccccaggacactaattatgatgcgaccaacagacactcctgggcgccctggtccgtttttcgggcctccctccgtcgggggcccaaagctgcccctgaaccccgtaagggggcncagccctgaggacgaggccgactattatgctactatcatttgatggtgtcgtctgtccctagttttcgggcggcgggaccgagggtggccgtccgtgggtcagcccaagggctcgcccctcgttcgctcttcgttcccnccctcctcctaacgtctacgctcgngccggg

SEQ ID NO: 390910 - DNA, 684 bp, Homo sapiens
  misc_feature: GZ8MTXP01BJFE4.17.75.G09.1.454.CMB.2.raw
  modified_base (267)..(267): a, c, t, g, unknown or other
  modified_base (291)..(291): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtcgcctccagcacgtggagaagtgaccagcgccactactcctactggttcaggtgagtcncggccacgcccagacactaattangatgaccgacaacagacactccgtcgggccgtccgttcggttccggttttcggcccttcccgtccggtcgggggaccaacggtctcgcccgtcggaaccccggtaacggggcgcgacgccgtaggacgggacggacgaccgtacttattacgtcgtacctaagtattacttagtttgacgttgggtcggttcgttcgttccggtacccggttacggttttccggggccgggtaccggggaccggtcgggggtccggtccggttcccggttgggtccgaccggcccgacggtcccgtcccggttcccccgtcggttccctaccgttcccgttcccgtttcccccaccccgttcccttcccgtaacgtcccgtacgttccgtcggcggtccgggg

SEQ ID NO: 390911 - DNA, 586 bp, Homo sapiens
  misc_feature: GZ8MTXP01EP627.17.75.G09.1.454.CMB.2.raw
  modified_base (286)..(286): a, c, t, g, unknown or other
  modified_base (299)..(299): a, c, t, g, unknown or other
  modified_base (313)..(313): a, c, t, g, unknown or other
  modified_base (544)..(544): a, c, t, g, unknown or other
  modified_base (558)..(558): a, c, t, g, unknown or other
  modified_base (573)..(573): a, c, t, g, unknown or other
  modified_base (580)..(580): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcgccactatcctatggtcaggtgagtctggccacggccccaggacactaattangatgacgaccaanagacactctgggcnccgtggtccgttttcggctcccgtcgtcgggggaccaaacggtctacgccctcggaaaccccgtaacgggggcacgaacgccctaggacgggacggacggtcccgacttattacgttcgaccttactattactagtttgagtggttgtcgttctcgtccgtagttttcggcgggtcgggacgtgggtcggtccgtcgtgggtcacggcccgaggcctcgccctacggttcncgtcttcgttcccnccctcctactcgtcncgctcgngtcggg

SEQ ID NO: 390912 - DNA, 663 bp, Homo sapiens
  misc_feature: GZ8MTXP01EE5SY.17.75.G09.1.454.CMB.2.raw
  modified_base (294)..(294): a, c, t, g, unknown or other
  modified_base (400)..(400): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcggccactactccctactggttccaggtgaagtctggccacggccccagacaactaattangatgacgaccaacagaccactcgtgggccgtcccgtggttccgttttcggcctcccgtccggtcgggggacaacggtcgtcgccctcggaacccgtaacgggggcncgacggccgtaggacgggacgacggaccgtacttagttacttcgacctactattctagtttgagttggtcgtcgttacgtcggtccgttacggttttccggggccgggtccggggaccgtacggggtccggccggttaccggttcgggtccgacggaccccgaagggtccctcccggcccccgtcgggttcctacccgttccttacccggttcccccttaccccttcccgtcctaacgtccgacgttcgtcggcgggtccggg

SEQ ID NO: 390913 - DNA, 698 bp, Homo sapiens
  misc_feature: GZ8MTXP01EENW2.17.75.G09.1.454.CMB.2.raw
  modified_base (265)..(265): a, c, t, g, unknown or other
  modified_base (290)..(290): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactactccctatggttccaggtgagtcnggccacggccccagacactaattangatgacgaccaacagacactccgtgggccgtcccgtggtccgttttcggccttcccgtccggtcgggggaccaacgcgtcgccccgtacggaaccccggtaacgggggccgaccgacggcccgtgggacggtacgggacggtacctacttagttacgtcgtacttactacttacgttagttgtaggttcgggttcggttccgttcgttaccggttaccgggtttacgggtttccggggaccggggtacccgggtaccgggtacggggtccggtcccggttccgggtcggtaccgtaccggcccgacggtccgtcccgttccccggtcggttcctacccgttccgttccccggttccccttccccgttccttccgttaaccgtccgtacgttcgtaacggcggtccggg

SEQ ID NO: 390914 - DNA, 601 bp, Homo sapiens
  misc_feature: GZ8MTXP01AD9SM.17.75.G09.1.454.CMB.2.raw
  modified_base (297)..(297): a, c, t, g, unknown or other
  modified_base (320)..(320): a, c, t, g, unknown or other
  modified_base (325)..(325): a, c, t, g, unknown or other
  modified_base (401)..(401): a, c, t, g, unknown or other
  modified_base (466)..(466): a, c, t, g, unknown or other
  modified_base (494)..(494): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcactggagaagtgaccagcggccactactccctactggttccaggtgaagtctggccacggcccccaggacactaatttangatgcgaacaacagacactccgngggcnccgtcggtccgtttttcggccttcccgtcgtcgggggaccaaagctcgccccgtggaaccccgtaacggggggccncgacgccgtggagggcgacgggccgactatttatcgacctactatactattgagttggtgtcgtntcgccgtagtttcgggcggcgggaccgngggtcggccgtcgtcgggtcacggccgaacggcctcgttcccccgtcggttcctaccgtccttccgttccccttccctccctcctcgtcctacgctcggcggccggg

SEQ ID NO: 390915 - DNA, 676 bp, Homo sapiens
  misc_feature: GZ8MTXP01EI992.17.75.G09.1.454.CMB.2.raw
  modified_base (224)..(224): a, c, t, g, unknown or other
  modified_base (297)..(297): a, c, t, g, unknown or other
tcagcgtagactagcacgaccggtgctcgatttagtatagacatcaggggctggcaccaggggtcccttccaatatcagcaccatggcctggactcctctcttttctgttcctcctcacttgctgcccagggtccaattcccaggctgtggtgactcaggaaccctcactgagtgtgtccccgaggggggacagtcattctcacctgtgcctccagcactgganaagtgaccagcgccactatccctatggttccaggtgaagtcgtggccacggccccaggactaacttaatttangatcgaccgaaaccaaacgacgacaccgtccgtaggggccgtcccgtttcggggttcccggttttttccgggccttcccccgtcggtccgggggacctaaacggtctcggccccgtacggaaaccccgggtaacgggggccacgacgccgtaggacgggacgacgggtacccgtagttattactcgaccttactattacttaagtttgtagtgggttgtcgttctcgtccggttacgtttcggggcggtaccgggacgtcggggtcggtccggtcggtcggtccacggacccgaggcctccggccccgtcggttacctccgttccttccgttccccttaccctcccttcgtaacgtcctacgccgtggttaacggcggg

SEQ ID NO: 390916 - DNA, 655 bp, Homo sapiens
  misc_feature: GZ8MTXP01BT9MW.17.75.G09.1.454.CMB.2.raw
  modified_base (293)..(293): a, c, t, g, unknown or other
  modified_base (529)..(529): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatccctatggttccaggtgaagtctggccacggcccccaggacactaatttangatgacgaccaacagacactccgtgggccgccgttgggtcccggttttttccgggccttccccgtccggtcggggggacccaaacggtctcgccccgtcggaaacccccgtaacggggggccgacgacgcccgtagggacgggacggacgggacccgtacttattagttcgcctacttatactatttgtagtggttgtcgtcgtcgtccgtagttttcggggccggtcgggaccgnggggtcggccggtccgtgggtccgacgcccgaaggctccgttcccccgtcggttccaccgttccttccgttccccttaccccttcccttccctaacgttcctacggttccgttcggcggtccgggg

SEQ ID NO: 390917 - DNA, 578 bp, Homo sapiens
  misc_feature: GZ8MTXP01CX5DE.17.75.G09.1.454.CMB.2.raw
  modified_base (293)..(293): a, c, t, g, unknown or other
  modified_base (315)..(315): a, c, t, g, unknown or other
  modified_base (384)..(384): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcacctgtgcctccagcacgtggagaagtgaccagcgccactactccctactggtccaggtgaagtctggccacggcccccaggacactaattangatgcgaccaacagacactcgnggcgccgtggtccgttttcggcctcccgtcgtcggggccaacgctcgccctcgaaccccgtacggggcncgacgccgtgacggacgacggaccgacttattacgtcgcctactatactatttgagtggtgtcgtcgtcgtccgttacgtttcgggcggcgggccgtcgggtcgccgtccgtgggtcacgcccaggcctccgccctcggactcgtcgttccgttccccgccctccgtacctcgtcctacgcgtcgcggtccggg

SEQ ID NO: 390918 - DNA, 559 bp, Homo sapiens
  misc_feature: GZ8MTXP01CRITB.17.75.G09.1.454.CMB.2.raw
  modified_base (294)..(294): a, c, t, g, unknown or other
  modified_base (316)..(316): a, c, t, g, unknown or other
  modified_base (386)..(386): a, c, t, g, unknown or other
  modified_base (389)..(389): a, c, t, g, unknown or other
  modified_base (411)..(411): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcacgtggagaagtgaccagcgccactatccctatggttccaggtgaagtctggccacggcccccaggacactaatttangatgcgaccaacagacactccngggctccgtggtccgttttcggccttcccgtcgtcggggaccaagctcgccctgaacccgtaacggggcncgngcctgacggacgagccgatatntcgctatatctattgtagtgtgtcgtcgtcgtccgtagtttcgggcggtcgggacgagggtcgccgtcgtcggtcacgccgaggccgtcgccccgtcggctaccgtcttccgttcccaccctcctcctcgtctacgcgtcgcgtcggg

SEQ ID NO: 390919 - DNA, 614 bp, Homo sapiens
  misc_feature: GZ8MTXP01EJ20H.17.75.G09.1.454.CMB.2.raw
  modified_base (532)..(532): a, c, t, g, unknown or other
  modified_base (578)..(578): a, c, t, g, unknown or other
  modified_base (604)..(604): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcggccactactccctactcggttccaggtgaagtcgtggccacggcccccaggacaacttaatttatgatgccgaccaacagacactccgtgggccgtcccgttggtccgtttttcgggccttcccgtccggtcgggggaccaaagctcgcccgtcggaaaccccgtacgggggcgcgacgtccgtggacgggacggacgggcccgtaacttaagttacgttcgttacctaaccttattacctagttttgagtgggtcgtcgttcgtcgtcccgttagttttccggcgggtcgggacgngggtcggtccgtcgtcggtcacgccgaggctcgcccctcggttccnctcttcgttcccgcctcctctcgtcncgctgcgcgg

SEQ ID NO: 390920 - DNA, 641 bp, Homo sapiens
  misc_feature: GZ8MTXP01BU4BT.17.75.G09.1.454.CMB.2.raw
  modified_base (292)..(292): a, c, t, g, unknown or other
  modified_base (320)..(320): a, c, t, g, unknown or other
  modified_base (393)..(393): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatccctatggttccaggtgaagtctggccacggcccccaggacactaattangatgacgaccaacagacactcgtgggcnccgtggtccgttttcggcctcccgtccgtcggggaccaaacgctcgccctcggaaaccccgtaacgggggccncgacgcccgtgggacggacggacgaccgtattattatcgtactatatacttagttagtgttggtcgtcgtcgtaccgtcggttacggtttccggggcgggtaccgggcggtacggggtcggtcccggttcgggtcggtccgaccggccgtacggtcccgtcccgccccggttccgttccgtccgttccgttccccgttcccccgttcccttcccttccgtaacgtccgtaccgcgtcggcgggtccgg

SEQ ID NO: 390921 - DNA, 718 bp, Homo sapiens
  misc_feature: GZ8MTXP01B9BHJ.17.75.G09.1.454.CMB.2.raw
  modified_base (310)..(310): a, c, t, g, unknown or other
  modified_base (343)..(343): a, c, t, g, unknown or other
  modified_base (421)..(421): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcggtccccgaggggggacagtcattctcacctgtcgccctccagcacgtggaagaagtgaccagccgccactactccctagtcggttccaggtgaagtcgtcggcccgacggccccccaggacaacttaatttangatgaccgaaccaacagacacctccgtgggccnccgttcggtccggttttcggccttcccgtcgtcggggaccaaacgctcgcccgtacggaaacccggtaaccgggggcnccgagtcccgagggaacgggacggacggacccgtacttattactcgaccttactattctaagtttgagttggtcgttcgtcgtcgtcccgttaggtttccgggccgggccgggtaccggcggggtccggtcccgttccgggtcgggtccgaccggtaccccgaacgggtccccgttcccggttcccccccgtcgggttccctcccgttcccgttccccgtttcccccggttccccctttccccgttcccgttaaccgttcccgtaccggttccgttaacgggttccgggtcccgggg

SEQ ID NO: 390922 - DNA, 587 bp, Homo sapiens
  misc_feature: GZ8MTXP01DUXP4.17.75.G09.1.454.CMB.2.raw
  modified_base (320)..(320): a, c, t, g, unknown or other
  modified_base (502)..(502): a, c, t, g, unknown or other
  modified_base (517)..(517): a, c, t, g, unknown or other
  modified_base (522)..(522): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatcctactggttccaggtgaagtctggccacggcccccaggacaactaatttatgatgcgaccaacagacactctgggcnccgtggtccgttttcggcctcccgtccgtcgggggccaaaggctcgccccgtcggaaccccgtaacgggggccgccgtacgcccgtaggacgggacggacgggcccgactattacttcgaccttactatactatttgagttcggtgtcgtctcgtcccgtagtttcggcgggtcgggaccgngggtcggccgtccgnggtcncgccgaggctcgcccgtcgctctcttccgttccttaccctcctcctcgtctacgctgcggtcggg

SEQ ID NO: 390923 - DNA, 625 bp, Homo sapiens
  misc_feature: GZ8MTXP01BN3VP.17.75.G09.1.454.CMB.2.raw
  modified_base (293)..(293): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcgccactatccctactggttccaggtgaagtctggccacggcccccaggacactaatttangatgcgaccaacagacactcgtgggcgcctggtccgttttcggcctcccgtcgtcggggccaaagctcgccctcggaaccccgtaacgggggccgcgacggcccgtggacgggacggacgggacccgacttattacttgacccttacttactacgtagtttgagttgggtggttcgtcgttcgtcccgtagtttttcggggccggtccgggtaccgaggggtcggccgttcgtcgggtcgacgcccgaacggcgtccgccccgtcggttcctacgttcttccgttccccttacccttccctcccgtaacgtcctacgcgttcggcgtccggg

SEQ ID NO: 390924 - DNA, 733 bp, Homo sapiens
  misc_feature: GZ8MTXP01BF4I6.17.75.G09.1.454.CMB.2.raw
  modified_base (264)..(264): a, c, t, g, unknown or other
  modified_base (291)..(291): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcactgtgcctcagcactggagaagtgaccagcgccactactcctactggttccaggtgaagtcgnggccacggccccaggacacttaattangatgacgaaccaacacgactacgtcgtcgggccgtcccgttcgggttccggtttttccggccttcccgtccggtaccgggggaccaaacggtcgtaccgcccgtaccggaaaccccgggtaacgggggccgtacgacggtccgtaggacgggacggacgggtacccgtactttagttacgttcgtaccttacttacgttacttagttttgaggttcggttggttccgttcgttccgtcccggtttaggttttccggggaccggggtccggggtaaccggtcgggggtccggtccgtccggggtcgggtaccgtaccggtacccgacgggtcccgttcccgggcccccttcgggttccctaccgttccgttcccggttcccccgccctttccccggtacccttaacggttcctacggttccgttcgggaaccgggtcccgggg

SEQ ID NO: 390925 - DNA, 609 bp, Homo sapiens
  misc_feature: GZ8MTXP01BTZQ6.17.75.G09.1.454.CMB.2.raw
  modified_base (530)..(530): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcactggagagtgaccagcgccactatcctactggtccaggtgagtctggccacggccccaggactactaatttatgatgaccgaaccaacagaaccaccgtccgtcgggggccgtcccgttcgggttcccggtttttccgggccttcccgtccggtcgggggaccaacggctcgccctcggaaaccccgtaacgggggcgcgacgccgtggacgggacggaggcccgtacgttattattcgtcctactatctatttgatggtgtcgtctcgccgtagtttcggcggtcggacgtgggtcgtccgtcgtcggtcncgccgaggtcctcgccccgtcggttcgtcctcgttccgttccccttccctccctccgtaacgtctacgcgtgcggtcgg

SEQ ID NO: 390926 - DNA, 673 bp, Homo sapiens
  misc_feature: GZ8MTXP01CLEXG.17.75.G09.1.454.CMB.2.raw
  modified_base (299)..(299): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtcgcctccagcacgtggagaagtgaccagcgccactactccctactggttccaggtgaagtcgtcggccacggccccaggactactaattangatgaccgaaccaacagaccacgtccgtgggccgtccgtttcgggtccggtttttccgggccttcccgtaccggtcgggggacccaacggctcgaccccgtacggaaaccccgggtaacgggggccgacgtaccggccgtaggacgggacggtacgggaccctacgttattacgtcgtacctactactacgttatttgagttggttcgtcgttcgtcgtccgtaggtttcgggccgggtacgggacgacggggtcggcccgtccggtggtaccgacgccgacggtcccgtccgttccccgtcgttcccgtaccgtccgttcccgttccccgccccttaacccttccgtaacgtccgtacgcgtggcggtccggg

SEQ ID NO: 390927 - DNA, 701 bp, Homo sapiens
  misc_feature: GZ8MTXP01AWLYR.17.75.G09.1.454.CMB.2.raw
  modified_base (294)..(294): a, c, t, g, unknown or other
  modified_base (409)..(409): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctcagcacgtggagaagtgaccagcgccactactccctatcggttcaggtgagtctcggccacggccccaggacacttaattangatgaccgaccaacgagaccacgtccgtgggcctccgtcggttccggttttccggccttcccgtcggtcggggaccaaacgtcgtcgcccgtacggaaacccgggtaacggggcncgacggccgtacgggacgggaccggacggtacccgtaacttacgttacgttcgtaccttaacttagttacgttagttttggacgttgggttcgtcgttcgtaccgtcccggttaggtttccggggccgggccgggtaccgtcgggggtccgtcccggtcggtcgggtccaccggcccgtagggtcccttcccggcccccgttcggttccctaccgttcccgttacccggttcccccttaccccttccctacccgttcgtccctaccggttcgtccggttaacgggtcccggg

SEQ ID NO: 390928 - DNA, 697 bp, Homo sapiens
  misc_feature: GZ8MTXP01DET5L.17.75.G09.1.454.CMB.2.raw
  modified_base (166)..(166): a, c, t, g, unknown or other
  modified_base (485)..(485): a, c, t, g, unknown or other
  modified_base (492)..(492): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtcgtccccgaggggggacagtcattctcacctgtcgcctccagcacgtggagaagtgaccagcgccactactccctactgtactcgaggagacgtcggcgaccgcccgaccgagtaacctaagtttaattcgagtagacgaccgaaacaacgacgacctaccgtcggcggccgtccggttcggtttccggttccgcccgttcccggtcgggtaccggaacgacgtccgtcccgaccgtaaacccgggtaccgggaacggcgacgaccgacggaggacggacggacgactaatttagtcgtcaccttatatnttgtagnggttcggtcgttctctccgggttacgtttacggggccgggcgggacccggtaagggtcggtcccggtccccggttggtcgaccgacccgaacggtcctcccgggttcccccgtccgttacgcccttcccggtttcccgttcccccggttcccccttccctccgttaaccggttccgtacgcccttaagggggccggtcccggggg

SEQ ID NO: 390929 - DNA, 666 bp, Homo sapiens
  misc_feature: GZ8MTXP01AYI5L.17.75.G09.1.454.CMB.2.raw
  modified_base (299)..(299): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcacgtggagaagtgaccagccggccactactccctagtggttccaggtgaagtcgcggccacggccccaggacaactaattangatgaccaaccaacacgacacgtcgtcgggccgtccgtcggtccggttttcggcctcccgtccggtcggggaccaagtctcgcccgtcgaaacccggtagggccgcgacgccgtgacgggacgacggcccgtaatagttagtcgacctactatctagtttgagttgggttgtcgtcgtcgaccggttacggtttcggggccgggtccggggtaacccggtgggggtccgtcccgggtaccggtcggggtaccgaccggcccgaacgggcccgtccggttcccccgttcgggttaccctccgtccgttcccggttccccgcccttccccgtccttaaccgtccgtacggccttaagggcgggtccggg

SEQ ID NO: 390930 - DNA, 594 bp, Homo sapiens
  misc_feature: GZ8MTXP01AB25B.17.75.G09.1.454.CMB.2.raw
  modified_base (223)..(223): a, c, t, g, unknown or other
  modified_base (259)..(259): a, c, t, g, unknown or other
  modified_base (264)..(264): a, c, t, g, unknown or other
  modified_base (286)..(286): a, c, t, g, unknown or other
  modified_base (299)..(299): a, c, t, g, unknown or other
  modified_base (314)..(314): a, c, t, g, unknown or other
  modified_base (336)..(336): a, c, t, g, unknown or other
  modified_base (349)..(349): a, c, t, g, unknown or other
  modified_base (371)..(371): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactgganaagtgaccagcgccactatccctatggttccaggtnagtcngcacgccccagacactaattangatgcgaccaacngacactccgtgggcnccgtggtccgttttcggctccncgtcgggcaagcncgccctgaacccgtacggggcncgacgccgtggacggacggacggcccgagttattaacgttcgaccttacttatctagtttgagttggttcgtcgttctacgcccggttagtttccggggcggtccgggaccgtggggtcggcccggttcgtcggtcacggcccgaggcctcgcccccgtacggcctacctcgttcccgttccccaccccgttcctcctcgtcccgtacgcgtcggcggccggg

SEQ ID NO: 390931 - DNA, 699 bp, Homo sapiens
  misc_feature: GZ8MTXP01EE621.17.75.G09.1.454.CMB.2.raw
  modified_base (267)..(267): a, c, t, g, unknown or other
  modified_base (291)..(291): a, c, t, g, unknown or other
  modified_base (314)..(314): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtcgcctccagcacgtggagaagtcgaccagcgccactactccctatgttcaggtgagtcncgccacggccccagacactattangatgacgaacaacagacactcgnggctccgtcggttccgttttcggcctcccgtcggtcggggaccaacgctcgcccgtacggaaccccggtaacggggccgacgacggccgtaggacgggacgggacggtacccgtacttagttacgttacgtaccttaacttacttacgttagttttaggtacgttgggttcggttccgttccgttccggttacccggtttacggttttcccgggggaccgggtccggggaccggtacgggggtccggtccggttccggtgggtccgaccggcccgaacggtccgtcccggttccccgtcggttacctccgttcccgttcccgttccccgttccccttcccgtacccgttaacgttcccgtacggttccgtaacggcgggtccggg

SEQ ID NO: 390932 - DNA, 718 bp, Homo sapiens
  misc_feature: GZ8MTXP01BHNCK.17.75.G09.1.454.CMB.2.raw
  modified_base (308)..(308): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcacctgtcgcctccagcacgtggagaagtgaccgagccgccactactccctacgtcggttccgaggtgacgtcgtcggcccgacggcccccaggactaacttaattangatcgaccgaaccaacacgaccacgtccgtcgggccgtcccgttcggttcccggttttccggcccttccccgtccggtacgggggacccaaacggtcgtccggcccgtaccggaaaccccgggtaacgggggccgacgaccggtccgtaggacgggtacggacggtaccgtacttattacgtcgtaccttacttattcgttagtttagtgttgggtcgtcgttcgtccgtccggttacggtttccgggcgggaccgggtacggtcggggtccggtcccggttccggtcggtaccgaccggtacccgtacgggtccctccccggttccccggttccggttcctacccgttccgttcccgttcccccttacccgttccgtacgttccgacgtcgttcggcggttcggtccgg

SEQ ID NO: 390933 - DNA, 610 bp, Homo sapiens
  misc_feature: GZ8MTXP01DMRNY.17.75.G09.1.454.CMB.2.raw
  modified_base (223)..(223): a, c, t, g, unknown or other
  modified_base (292)..(292): a, c, t, g, unknown or other
  modified_base (306)..(306): a, c, t, g, unknown or other
  modified_base (319)..(319): a, c, t, g, unknown or other
  modified_base (381)..(381): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactgganaagtgaccagcgccatatccctactggttccaggtgaagtctggccaggcccccaggacactaatttangatgacgaccaacngacactctgggcnccgtggtccgtttttcggccttcctcgtcgggggaccaagctgccctgaacccgtaggggcnacgcctggacggacgaggcccgtatattattcgccttacgttatactatttgagtggtcggtcgtcgtcgtacccgtagttttccggggccggtacgggtaaccgtggggtcgccgttcccgtgggtccacgcccgtaaggtccgtccgcccccgttcgggcctaccgtccttccgttccccgttccccttcccgtccgtaacgttcctacgcgttcgaacggtccggg

SEQ ID NO: 390934 - DNA, 579 bp, Homo sapiens
  misc_feature: GZ8MTXP01BY71G.17.75.G09.1.454.CMB.2.raw
  modified_base (314)..(314): a, c, t, g, unknown or other
  modified_base (318)..(318): a, c, t, g, unknown or other
  modified_base (373)..(373): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcacctgtcgcctcagcactggagaagtgaccagcgctactactccctatcggttcaggtgaagtcgcggccacggccccaggacactattatgatgacgacaacagacactcgnggcncgtgtccgtttcgcctccgtcgtcgggacagctcgcccgtcgaacccgacgggcncgacgccgtggacgacgacgacctatacttagtcacgttactatacttattcgtatgggtgtcgtcgtcgtccggtacgtttccgggcggccgggacgtgggtccgtccgtcgtcggtcgacgcccgagggtcctccgttcccctcggttcaccgttccgttccgttccccgccttccctccgtcgtctacgcgtcggcgtccggg

SEQ ID NO: 390935 - DNA, 691 bp, Homo sapiens
  misc_feature: GZ8MTXP01BGCWN.17.75.G09.1.454.CMB.2.raw
  modified_base (305)..(305): a, c, t, g, unknown or other
  modified_base (330)..(330): a, c, t, g, unknown or other
  modified_base (335)..(335): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcacggaaccctcactgagtgtgtccccgaggggggacagtcattctcacctgtcgcctccagcacgtggaagaagtgaccgagccggccactactccctacgtcggttccaggtgaagtcgtcggccacggccccaggactactaattangatgacgaccaaacagacacgtcgngggcnccgtggtccgttttcggcctcccgtcggtcggggaccaacgcgtcgcccgtcggaaacccgggtacggggccgcgacggtccgtagggacgggacggacgggtacccgtacttattacgttcgtaccttaacttattacgtagtttgtagttgggtcgttcgttcgtccgtccggttacgtttcggggcgggtccggggtaccgtcgggggtcggtcccggtacgtcggggtaccgccgacccggtaacggtcccgtcccgttccccggttcccggttccgtacccgttccgttcccgttccccgttccccttcccgtacccgttcgttcccgtaccggttcgtcggcggtccggg

SEQ ID NO: 390936 - DNA, 712 bp, Homo sapiens
  misc_feature: GZ8MTXP01EQD6O.17.75.G09.1.454.CMB.2.raw
  modified_base (308)..(308): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccaggtccaattcccaggctgtggtgactcacggaaccctcactgagtgtcgtccccgagggggacagtcattctcactgtcgcctccagcacgtggagaagtcgaccagccgcctactactccctacgtcggttcgaggtgaacgtcgtcggccgacggcccccaggactaacttaatttangtactgaccgaaccaactacgactacctccggtcgggccgtccgttcgggtttcccggttttcggacccttccccgtccggtccggggaccaaacggtcgtaccgcccgtaccggaaaccccgggtaacggggccgacgacgccggtacggaacgggtacgggacgtaccgtacttagtttacgtcgtaccttactattccgttagtttaggtagtcgggttcgtccgtcgttccgtacccgggttcgtttccggggccgggaccggggtaccgtgggtcccggtccgttacggtcggtcgaccggccgcggtccctcccggttccccgtcgttccctacgttcccgttcccgttcccttaccccttcgtacccgttcgtaccgcgttacgtcggcggtccggg

SEQ ID NO: 390937 - DNA, 672 bp, Homo sapiens
  misc_feature: GZ8MTXP01BAPQV.17.75.G09.1.454.CMB.2.raw
  modified_base (297)..(297): a, c, t, g, unknown or other
  modified_base (416)..(416): a, c, t, g, unknown or other
  modified_base (618)..(618): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcactggagaagtgaccagcggccactactccctatcggttccaggtgaagtcgcggccacggcccccaggacacttaattngatgaccgaccaacagaccactccgtgggccgcccgtgggttcccgttttccgggccttccccgtccggtcgggggacccaacggtcgtcgccccgtcggaaccccgggtacgggggcnccgacgccgtagggacggacggacgggaccgtacttagttacgttcgacccttaactatcttagtttggaggttgggttcggttccgtcgttccgtcccggttgtttccggggccggggtaccgggtacccggtagggggtccggtcccggttccggtcgggtccgacggtcccggagcccgtcccgccccgtacggttccnccttccttccgttccccaccccttcctacccgtaagcctcgcgtcgcgggtcgg

SEQ ID NO: 390938 - DNA, 725 bp, Homo sapiens
  misc_feature: GZ8MTXP01B3QGC.17.75.G09.1.454.CMB.2.raw
  modified_base (516)..(516): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtcgcctcagcacgtggagaagtcgaccagccgcactactccctacgtggtccaggtgaacgtcgtcggccgcggccccaggactaacttaatttatgatcgaccgaaccaacagacctacctccgtcgggccgtcccgttcgggttccggtttttccggccttccccgtccggtccgggggaccaaacggctccgcccgtacggaaccccgggtaacgggggcgacgacggccgtaggaacggggaccggacgggtacccgtaacttatttacgtttcgtaccttaacttacgttacgttagtttaggngttgggttcgttcgttcgttcccgtccgggttacgttttccggggaccgggtccggggaaccggtcggggtccgggtccgtccgggtcgggtccgaccggacccggacggtcccgtcccggttcccccggtcggttccctccgttcccgttcccgttcccccttccccgttcctcccgtcgttcccgtacgcgtaacggcgggtccggg

SEQ ID NO: 390939 - DNA, 600 bp, Homo sapiens
  misc_feature: GZ8MTXP01APRM2.17.75.G09.1.454.CMB.2.raw
  modified_base (289)..(289): a, c, t, g, unknown or other
  modified_base (445)..(445): a, c, t, g, unknown or other
  modified_base (456)..(456): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccaggtccaattcccaggctgtggtgactcaggaaccctcactgagtgtgtccccgagggggacagtcattctcacctgtgcctcagcactggagaagtgaccagcgccactatcctatggttccaggtgaagtctggccaggcccccaggacactaagtttangatcgaccgaccaacacgtaccaccgtcgtcgggccgtccgttcggttccggtttcggcctcccgtccggtcgggaccacggcgtcgcccgtacggaacccggtacggggcgcgacgccgtaggacggacgacgccgtacttattcgtcgactatntacgtagttgngtggtgtcgtcgtcgtccgttggttcgggcgggacgggacgtgggtcggccgtcgtcggtcgacgccgacggtcctccggttcccgtcgttccgtcttccgttccgttcccttcccttcctccgtcgtctcgcgtcggcggcgg

SEQ ID NO: 390940 - DNA, 704 bp, Homo sapiens
  misc_feature: GZ8MTXP01B3T31.17.75.G09.1.454.CMB.2.raw
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcacctgtcgcctccagcacgtggagaagtcgaccagccgcactactcctacgtggtccaggtgaagtcgtcggccgacgaccccgaggactaacttaatttatgatcgacgaccaaacacgaccactcccgtcgggccgtccgttcgggttcccggtttttccggcccgttccccgtccggtacgggggacctaaacggtcgtccggcccgtaccggaaacccgggtaacggggccgacgacgtccgtaggacgggacggacgggacccgtattagttacgttcgccttaacgttacttagtagtttgtgttcgggtggttccgttcgtcggttacccggttacggttttccggggccgggtcggggacggtaccgggggtcggtccccggtcggtacgggtccgacggcccgtaaggcccgtccgaccccggtcggttacctccgttcttcccgttccccttacccgttcctccgtaacgtccgtacgcgtcggttcggcggg

SEQ ID NO: 390941 - DNA, 555 bp, Homo sapiens
  misc_feature: GZ8MTXP02GX65Z.17.75.G09.1.454.CMB.2.raw
tcagcgtagactagcacgaccggtgctcgatttagtatagacatcagggctggcaccaggggtcccttccaatatcagcaccatggcctggactcctctctttctgttcctcctcacttgctgcccagggtccaattcccaggctgtggtgactcaggaaccctcactgagtgtgtcccccaggggggacagtcattctcacctgtgcctccagcactggagaagtgaccagcggccactatccctactggttccaggtgaagtctggccaggcccccaggacactaattatgatgcgacaacagacactcctgggcgccctggtccgtttttcgggctccctccgtcggggccaaagctgccctgacccgtaacggggcgcagcctgagacgaggccgactattatgcctactatcattgtatggtgtcgtctgtccctagttttcggcggtcgggaccgaggggcgccggtccgtcgggtcgacgccaacggtctccggcccctcggtccactcgtcgttcccgccctcctcctacgtctacgctcgacgcgg

SEQ ID NO: 390942 - DNA, 567 bp, Homo sapiens
  misc_feature: GZ8MTXP02HMFQQ.17.75.G09.1.454.CMB.2.raw
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctcccgtccgtcggggccaaagctcgccctgaccccgtaacggggccgcgagccgtgaggacgaggcccgacgtattattgcctactatctattgagtggtgtcgtctcgtcctagttttcggcgggtcgggaccgaggggtcggccgtccgtgggtcgacgccgaacggcgtcgccccgtcggtcactcctcgttcccaccctcctcctacgtctacgctcgacgcggg

SEQ ID NO: 390943 - DNA, 570 bp, Homo sapiens
  misc_feature: GZ8MTXP02JOJ8E.17.75.G09.1.454.CMB.2.raw
  modified_base (318)..(318): a, c, t, g, unknown or other
  modified_base (378)..(378): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaattatgatgcgacaacagacactcctgggcncctggtccgttttcgggctcccgtcgtcggggccaagctcgccctgacccgtacggggcncgagcctgaggacgaggccgactattattgcctactatctattgagtggtgtcgtctcgtccctagtttcggcgggtcgggacgagggtcggccggtcgtggtcgacgcccgaaggccgtccgcccccgtcggtcctacgtcctccgttccccaccctccctcctacgtcctaccgtcgtcgacggtccggg

SEQ ID NO: 390944 - DNA, 553 bp, Homo sapiens
  misc_feature: GZ8MTXP02JAAUM.17.75.G09.1.454.CMB.2.raw
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccaggggggacagtcattctcacctgtgcctccagcactggagaagtgaccagcggccactatccctactggttccaggtgaagtctggccaggcccccaggacactaattatgatgcgaccaacagacactcctgggcgcctggccgtttttcgggctccctccgtcggggccaaagctgccctgaccccgtaacggggcgcagcctgaggacgaggccgactattatgctactatcattgatggtgtcgtctgccctagttttcggcggcggggtacccgagggtcggccgtcgtgggtccagcccgaaggctcgccccctcggtccactctcgtccccaccctcctcctacgtcctacgctcgacgccgg

SEQ ID NO: 390945 - DNA, 594 bp, Homo sapiens
  misc_feature: GZ8MTXP02FN439.17.75.G09.1.454.CMB.2.raw
  modified_base (290)..(290): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcgccactatccctactggttccaggtgagtctggccacggccccaggacactaattangatgcgaccaacagacactccgtgggcgccgtcggtccggtttttcgggccttccccgtccgtcggggacccaaagctcgccctcgacccgtaacggggcgcacgccgtgaggacgaggccgactattattcgcctactatcatttgatggtgtcgtctcgcctagtttcggcggtcgggacgagggtcggccggtcgtcgggtcacgtaccgaacggccgtcgcccccgtcggtcctacgttccgtccgttcccccaccccttcccgtcccgttacgtccgtacgtcgtacggacggtccggg

SEQ ID NO: 390946 - DNA, 621 bp, Homo sapiens
  misc_feature: GZ8MTXP02I0MOH.17.75.G09.1.454.CMB.2.raw
  modified_base (319)..(319): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctggcncctggccgtttttcgggctccctccgtcggggccaagctgccctgacccgtaacggggcgcagccctgacggacgaggccgactattatgcctactatctattgatggtgtcgtctcgtccctacgttttcggcgggtcgggtaccgacggggtcggtcccggtccgtcggggtccgtaacggccccgaacgggtcccgtcggccccccgttcggggtccctaccgttccgttccgtttcccccacccccgtttcccgttccccttacgttcccgtaccggtccttcggacggtcccggggg

SEQ ID NO: 390947 - DNA, 569 bp, Homo sapiens
  misc_feature: GZ8MTXP02FIM57.17.75.G09.1.454.CMB.2.raw
  modified_base (384)..(384): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggccccccaggacactaatttatgatgcgaccaacagacactcctgggcgcctggccgtttttcgggcctccctccgtcggggccaaagcctgccctgacccgtaacggggcncagcctgaggacgaggccgactattatgcctactatcatttgatggtggtcgtctcgccctagttttccgggcgggtccggggaccgaggggtcggccggtccgtggggtccacgcccgaaggcctcgcccccgtcggtccacgtctcgttcccgccctccgtcctacgtcctacgctgcgcggg

SEQ ID NO: 390948 - DNA, 570 bp, Homo sapiens
  misc_feature: GZ8MTXP02F8L3W.17.75.G09.1.454.CMB.2.raw
  modified_base (166)..(166): a, c, t, g, unknown or other
  modified_base (378)..(378): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtgtccccaggggggacagtcattctcacctgtgcctccagcactggagaagtgaccagcggccactatccctactggttccaggtgaagtctggccaggcccccaggacactaattatgatgcgaccaacagacactctgggcgccgtggtccgttttcggctcccgtcgtcggggaccaagctgccctgacccgtaaggggcncacgcctgaggacgacggccgactattatgctactatcatttgatggtgtcgtctcgccctacgttttcggcgggtcgggaccgacggggtcggccgtccgtcgggtcgacgcccgaacggcgtccgcccccgtcggtcctactcgtccgtccccgcccgtcccgtcctacgtctacgtcgtcgacgccggg

SEQ ID NO: 390949 - DNA, 569 bp, Homo sapiens
  misc_feature: GZ8MTXP02H3PKD.17.75.G09.1.454.CMB.2.raw
  modified_base (295)..(295): a, c, t, g, unknown or other
  modified_base (345)..(345): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccgagggggacagtcattctcacctgtgcctccagcactggagaagtgaccagcggccactatccctactggttcccaggtgaagtctggccaggcccccaggacactaatttangatgcgaccaacagacactcctgggcgcctggtccgttttcggcctcccncgtcggggccaagctcgcctgacccgtaacggggcgcagcctgacggacgaggcccgactattattgcctactatctatttgagtggtgtcgtctgtccctagtttcggcgggcgggaccgaggggtcggccggttcgcgggtcgacgcccgaacggctcgcccccgtcggtccaccgttcgtcgttccccgccctcccgtcctacgtcctacgctcgcggcgg

SEQ ID NO: 390950 - DNA, 570 bp, Homo sapiens
  misc_feature: GZ8MTXP02HFKZF.17.75.G09.1.454.CMB.2.raw
  modified_base (512)..(512): a, c, t, g, unknown or other
tcagcgtagactagcacgaccggtgctcgatttagtatagacatcaggggctggcaccaggggtcccttacaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatcccctactggttccaggtgaagtctggccaggcccccaggacactaatttatgatgcgaccaacagacactcctgggcgccctggccgtttttcgggctccctcctcggggccaaagcctgcccctgaccccgtaacgggggccgacagccctgacggacgaggccgactattattgcctactatctattgattgggtgggtcgtctcgccctagttttcgggcggcggggacccgaggggtcggccgtccgtgggtcagcccaaggccncgccccctcggtcacgtctcgttcccgccctccgtcctacgtctacgctcgacgcggg

SEQ ID NO: 390951 - DNA, 538 bp, Homo sapiens
  misc_feature: GZ8MTXP02IPSOL.17.75.G09.1.454.CMB.2.raw
  modified_base (290)..(290): a, c, t, g, unknown or other
  modified_base (315)..(315): a, c, t, g, unknown or other
  modified_base (484)..(484): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctatggttccaggtgaagtctggccaggccccaggacactaattangatgcgacaacagacactcctggcncctggccgttttcgggctccctctcggggccaaagctgccctgacccgtaaggggcgcagcctgaggacgaggtccgactatattgctactatcattgatggtgtcgtctgtcccagttttcggcggcggggaccgaggggtcggccgtccgtgggtcagcccaaggcncgcccccgtcggtcactctcgttcccaccctcctctacgtctacgctgacgcgg

SEQ ID NO: 390952 - DNA, 558 bp, Homo sapiens
  misc_feature: GZ8MTXP02G8B5S.17.75.G09.1.454.CMB.2.raw
  modified_base (489)..(489): a, c, t, g, unknown or other
  modified_base (514)..(514): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcggccactatccctactggttccaggtgaagtctggccacggcccccaggacactaattatgatgcgaccaacagacactctggcgcctggccgttttcggctccctcgtcggggccaagctcgccctgacccgtacggggccgcgacgccgtgacggacgagggccgacgtattattcgctactatctattgagtggtcgtcgttctcgtcctagtttcggcggtcgggaccgtacgggtcggccgtcgtggtcncgccgagtcctcgccccgtcggtcnctctcgttcccaccctcctccgtacgtacgcgtcgcggcggtcg

SEQ ID NO: 390953 - DNA, 555 bp, Homo sapiens
  misc_feature: GZ8MTXP02JYLO9.17.75.G09.1.454.CMB.2.raw
  modified_base (319)..(319): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaattatgatgcgaccaacagacactcctgggcncctggtccgtttttcgggctccctcgtcggggccaaagctgccctgacccgtaacggggcgcagcctgaggacgaggcccgactattattgcctactatctattgattggtgttcgtctcgtccctagttttcggcggtccgggaccgagggtcggccgtccgtgggtcagcccaaggctcgccccgtcggtcactcctcgtcccaccctcctcctacgtcctacgcctgacgcgg

SEQ ID NO: 390954 - DNA, 624 bp, Homo sapiens
  misc_feature: GZ8MTXP02GR1LQ.17.75.G09.1.454.CMB.2.raw
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaattatgatgcgacaacagacactccgtggcgccgtggtccgtttttcgggcctccctccgtcggggccaaagctgccctgaccccgtaacggggcgcgagccgtgaggacgaggcccgactattattgctactatctattgatggtgtcgtctcgtccctagttttccggcgggtcgggaccgacggggtcgggtccggtccgtggggttccgaacggtccccgaaacgggtccgtccggtcccccgtccgggtccctaccgttcccgtccgtttcccccgccccttccccgttccccttaccggttccttaaccgccgttcggtacggtcccgggg

SEQ ID NO: 390955 - DNA, 542 bp, Homo sapiens
  misc_feature: GZ8MTXP02FSXCP.17.75.G09.1.454.CMB.2.raw
  modified_base (167)..(167): a, c, t, g, unknown or other
  modified_base (374)..(374): a, c, t, g, unknown or other
  modified_base (380)..(380): a, c, t, g, unknown or other
  modified_base (472)..(472): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaacccctnactgagtgtgtccccaggggggacagtcattctcacctgtgcctcagcactggagaagtgaccagcggccactatccctatggttccaggtgaagtctggccaggcccccaggacactaatttatgatgcgaccaacagacactctggcgcctggccgtttttcggctccctcgtcggggccaaagctgccctgacccgtaggggcncagccngagacgaggaccactagttatgcctatatcatttgattggtgtcgtctcgcctagtttcggcgggtcgggacgacgggtgccgtcgtggtcngaccgagccgtcgcccccgtcggctactcgtcgtccccgccctccctcctcgtactacgctcggcgccgg

SEQ ID NO: 390956 - DNA, 675 bp, Homo sapiens
  misc_feature: GZ8MTXP02JSR6Q.17.75.G09.1.454.CMB.2.raw
  modified_base (300)..(300): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcacctgtcgcctccagcacgtggagaagtgaccagccggccactactccctactcggttccaggtgaagtctggccacggcccccaggacactaatttangatgcgaccaacagacactcctggcgccgtggtccgtttttcggccttccccgtccggtcggggaccaacgtctcgcccgtcgaaccccggtacggggccgacgacgccgtaggagggaccggacgggcccgtacgttaacgttagttcgtacccttagttactcttacgtttgtagttgggtcggttcgtcgtaccgtcccgttaggtttcgggccgggtaccgggggaccgtaggggtcccgggtcccggttccgtcggggtccgtaccgacccggaacgtcccgtcccgcccccgtccgggtcctccgttccgtcccgtttcccccaccctccctcccgttaaccgtccgttacgccgtcggcggtccgggg

SEQ ID NO: 390957 - DNA, 611 bp, Homo sapiens
  misc_feature: GZ8MTXP02F5LPM.17.75.G09.1.454.CMB.2.raw
  modified_base (263)..(263): a, c, t, g, unknown or other
  modified_base (289)..(289): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcgccactatccctatggtccaggtgagtcnggccacggccccaggacactaattangatgcgacaacagacactccgtggccgccgtcggtccggtttttcggcctcccgtccggtcggggaccaacgcctcgcccgtcggaccccggtaacggggccgcgacggccgtaggacggacggacggaccgtacttagttacgttcgtaccttactatctatttgagtggtggtcgtctcgtccgtagtttcggcgggcgggaccgacgggtcggccgtcgtcggtcgacgcccgaacggccgtccgccccgtcgtcctaccgtccgtccgttccccgtcccctcccgtcccgtacgtccgtacgtcgtcggacggtcggg

SEQ ID NO: 390958 - DNA, 626 bp, Homo sapiens
  misc_feature: GZ8MTXP02IYD6K.17.75.G09.1.454.CMB.2.raw
  modified_base (310)..(310): a, c, t, g, unknown or other
  modified_base (442)..(442): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtgcctccagcactggagaagtgaccagccggccactactccctactggttccaggtgaagtctggccaggcccccaggacactaattatgatgcgaccaacanacactctggcgcctggccgttttcggcctcccgtccgtcggggccaaacgctacgcccgtcggaccccgtaacgggggccgcacgccgtagaggaacgagggcccgaactagtttacgttcgccttaacttnttactagtttgtaagtggttcggtcgttcgtcgccctagtttcggccgggtcgggacgacggggtcggccgtccgtacgggtcacggtcccgaaggtcctccggcccccgtcggtcccaccgttccgttccgttccccctaccccttccctccctacgttccctacgtccgtacggcgccgggg

SEQ ID NO: 390959 - DNA, 577 bp, Homo sapiens
  misc_feature: GZ8MTXP02HL2UA.17.75.G09.1.454.CMB.2.raw
  modified_base (266)..(266): a, c, t, g, unknown or other
  modified_base (293)..(293): a, c, t, g, unknown or other
  modified_base (489)..(489): a, c, t, g, unknown or other
  modified_base (548)..(548): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtcccccgaggggggacagtcattctcacctgtgcctccagcactggagaagtgaccagcggccactatccctatggtccaggtgaagtcnggccacggcccccaggacactaattangatgacgaccaacagaccactccgtgggccgtccgtggtcccggtttttcgggcctccccgtccgtcggggaccaacgcctcgccctcggaccccggtacggggccgcgacgccgtaggagacggacggccgactattactgcctactatactattgagtggtgtcgttcgcgtctacgtttcggcggcgggacgngggtcggccgtcgtggtcgacgtccgacgcgccgccccgtcggactcctctcgtacccncgtcctcctccgtactctacgcgtgtcgg

SEQ ID NO: 390960 - DNA, 694 bp, Homo sapiens
  misc_feature: GZ8MTXP02HGBZW.17.75.G09.1.454.CMB.2.raw
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcacctgtgccctccagcacgtggagaagtgaccagcggccactatccctatggttacaggtgaagtctggccaggcccccaggacactaatttatgatgcgaccaacagacactccgtggcgcctggccgttttcggcctccctcgtcggggccaaagctcgccctgaccccgtaacggggccgtcgacggcctggacgggacgacgggcccgaactattacgttcgtacctaccttataccttatttagtacgttgggttcggtcggttccgtcggttacccgtcgtttttccggggcgggtccggggaacccgtcggggtcgggtcccggttccggtcggggttcgaccggacccgtaaacgggccgtccggccccccggttccgggtcccgtaacccgttcccgttccggttaacccccctaccccccgtttcccttcccccgttaccggttacccttaacccggtaccgttccggaacgggtccccggggg

SEQ ID NO: 390961 - DNA, 557 bp, Homo sapiens
  misc_feature: GZ8MTXP02GSVZG.17.75.G09.1.454.CMB.2.raw
  modified_base (294)..(294): a, c, t, g, unknown or other
  modified_base (381)..(381): a, c, t, g, unknown or other
  modified_base (528)..(528): a, c, t, g, unknown or other
tcagcgtagactagcacgaccggtgctcgatttagtatagacatcaggggctggcaccaggggtcccttccaatatcagcaccatggcctggactcctctctttccgttcctcctcacttgctgcccagggtccaattcccaggctgtggtgactcaggaaccctcactgagtgtgtccccgaggggggacagtcattctcacctgtgcctccagcactggagaagtgaccagcgccactactccctactggttccaggtgaagtctggccacggcccccaggacactaattangatgcgacaacagacactctggcgcgtcggtccgtttttcggcctcccgtccgtcggggcaaacgctgccctgacccgtacggggcncgacgcctggaggacggacggaccgagtattattgcctatatctattgatggtggtcgtcgtagcccgtatttcggtcgggcgggacgagggtcgccgtcgtgggtcacgcccgaggcctcgcccctcggtcacgtctcgttacccnccctcctctactctacgctcgcgcggtcg

SEQ ID NO: 390962 - DNA, 550 bp, Homo sapiens
  misc_feature: GZ8MTXP02I5U44.17.75.G09.1.454.CMB.2.raw
  modified_base (292)..(292): a, c, t, g, unknown or other
  modified_base (312)..(312): a, c, t, g, unknown or other
  modified_base (316)..(316): a, c, t, g, unknown or other
  modified_base (425)..(425): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaattangatgcgacaacagacactcnggcncctggtccgttttcggctcccgtcgtcgggacaagctcgccctgacccgtaacggggcgcacgcctagaggacgaggcccgactattactgacctactaatctatttgnttaggtgtcgtctcgcctagtttcggcggtcgggaccgagggtcggccgtcgtggtcgagcccgaaggctcgccccgtcgtcgactctcgtccctaccctccgtcctcgtctacgctcgacgcgg

SEQ ID NO: 390963 - DNA, 620 bp, Homo sapiens
  misc_feature: GZ8MTXP02JJRUW.17.75.G09.1.454.CMB.2.raw
  modified_base (302)..(302): a, c, t, g, unknown or other
  modified_base (574)..(574): a, c, t, g, unknown or other
  modified_base (611)..(611): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcacgtggagaagtcgaccgagccggccactactccctacgtcggttccaggtgagtcgtcggccacggccccaggacactaattangatgacgaccaacgacgacctacgtccgtcgggccgtccgtcggttccggtttttccgggccttccccgtccggtcggggacctaaacggtcctacgcccgtacggacccggtaacggggccgacgacggccgtagggacggacggacggaccgtaacgttattagtcgcctactactctagttgtagttgggtcgtcgtctcgtccgttagtttcgggcgggtccgggacgtcgggtcggcgtcgtggtcacgcgacgcgcgcccgtcgcncgtctccgtcccgccctccgtccgtcgtcctacgtcncggcgtcgg

SEQ ID NO: 390964 - DNA, 673 bp, Homo sapiens
  misc_feature: GZ8MTXP02F8BQH.17.75.G09.1.454.CMB.2.raw
  modified_base (166)..(166): a, c, t, g, unknown or other
  modified_base (293)..(293): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtgtccccgaggggggacagtcattctcacctgtgcctccagcactggagaagtgaccagcgccactactccctactggttccaggtgaagtctggccacggccccaggacactaattangatgcgaccaacagacactccgtggcgccgtggtccgtttttcggcctcccgtccggtcggggacaaagctcgccctcgacccgtaacggggcgcgacgccgtagacgggacgacgggaccgtaacgtattacgttcgacctacttaatctagtttagtagttggttcggtcgttcgtcgtcccgtacgtttttccggggccgggtaccggggaccggtacggggtcgggtcccggttccggtcggggttaccgacgggcccgaaacggtccgtcccggtcccccggttccggtacccgtaccgttccgttccgtttaccccctaccccgttccccttacccgtacgttacccgtaccgtcgttacggacggtcccgggg

SEQ ID NO: 390965 - DNA, 675 bp, Homo sapiens
  misc_feature: GZ8MTXP02HCBYV.17.75.G09.1.454.CMB.2.raw
  modified_base (304)..(304): a, c, t, g, unknown or other
  modified_base (429)..(429): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtcccgagggggacagtcattctcacctgtcgcctccagcacgtggagaagtcgaccagccgccactactccctacgtcggtaccgaggtcgacgtcgtcggccacggccccagactacttaattacngatcgaccaaaccaacacgacctactccggtcgggccgtcccgttcggttcccggttttcgggcccttcccgtaccgggtcggggacccaacgtcaccgcccgtacggaccccggtaacggggcnccgtacgcgtagacgggacgacggtaccgtacttacgttacgttcgtaccttaatacttacgttagttaggtagttgggttacgttcgttacgtccgttaccgtggtttccgggcgggtaccgggacgtcggggtccggtccgtcggtcgggaccgaccgaccgtacggtccgtcccgtccccgtacggtcctcctccgttcccgtcccctacccgtctaccgtcgtcctcgtcgacggcggtcgg

SEQ ID NO: 390966 - DNA, 581 bp, Homo sapiens
  misc_feature: GZ8MTXP02GW5H7.17.75.G09.1.454.CMB.2.raw
  modified_base (322)..(322): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcacctgtcgcctccagcactggagaagtgaccagcggccactactccctactggttccaggtgaagtctggccacggcccccaggacactaattatgatgcgaccaacagacacctcgtggcnccgtggtccgttttcggcctcccgtccgtcggggaccaacgctcgccctacggaccccgtaacggggcgcacgccgtgacggacgacggccgatattatcgcctactatctatttgagtggtgtcgtctcgtcctagtttcggcggtcgggaccgaggggtcggtccgtcgtggtccgacgacccgaggcctccgcccccgtcggtccacctcgtccgtcccaccctcctccgtacgtcctacgtctcggacggccggg

SEQ ID NO: 390967 - DNA, 617 bp, Homo sapiens
  misc_feature: GZ8MTXP02JBXIX.17.75.G09.1.454.CMB.2.raw
  modified_base (296)..(296): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtgcctccagcactggagaagtgaccagcgccactactccctactggttccaggtgaagtcgtggccacggccccaggactactaattangatgacgaccaacacgaaccactccgtgggccgcccgtcgggtcccgtttttcgggccttccccgtccggtcggggacctaaacgcctcgccctacggacccggtacggggcgcgacggccgtggacggacggacggcccgactattacttcgtacttactattactagtttacgtagttcggtggttcgtctcggtccgtagtttccgggcgggtcgggacgagggtcggccgtcggtggtcacgccgacggtctccgccccgtcggtccaccgtccttccgtccccaccctccctccgtacgtccacgctcggacgcgg

SEQ ID NO: 390968 - DNA, 574 bp, Homo sapiens
  misc_feature: GZ8MTXP02II5DT.17.75.G09.1.454.CMB.2.raw
  modified_base (311)..(311): a, c, t, g, unknown or other
  modified_base (317)..(317): a, c, t, g, unknown or other
  modified_base (532)..(532): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagaagtgaccagcggccactatccctactggttccaggtgaagtctggccaggcccccaggacactaattatgatgcgacaacagacacnctggcncctggtccgtttcggctcctcgtcggggccaaagctcgccctgacccgtaacggggcgcagccgtagacggcgacggccgactatacttgacctatatctactttgattgggtagtcgtctcgtcctagtttcgggcggcgggaccgagggtcggccgtcgtcgggtcacgaccgaggccgtcgcccccgtcggtccacttccgtccgttccccncccgtccttccctacgttccgtacgtcgtacgacggccgggg

SEQ ID NO: 390969 - DNA, 647 bp, Homo sapiens
  misc_feature: GZ8MTXP02GGRTB.17.75.G09.1.454.CMB.2.raw
  modified_base (296)..(296): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtcgcctccagcactggagaagtgaccagcggccactactccctactggttccaggtgaagtctggccacggcccccaggacactaattangatgacgacaacagacactccgtggctccgtggtccgttttcggcctccgtccgtcggggaccaagctcgccctcggacccgtaggggccgcacgccgtaggacgggacgacggccgtactattagtcgacctactattctatttgagttggtggtcgtcgtcgtccgttacgtttccgggcgggtaccggggaccgacggggtcgggcccgttccggtcgggtccgaccggaccccgaacgggtcccgtcccggtcccccgttccggtacccgtaccgttcccgttcccgttcccccgtccccgttcccgttcccgttacgtcccgtaaccgtcgtcggacggtcccggg

SEQ ID NO: 390970 - DNA, 618 bp, Homo sapiens
  misc_feature: GZ8MTXP02HBIYO.17.75.G09.1.454.CMB.2.raw
  modified_base (296)..(296): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcacctgtcgcctccagcactggagaagtgaccagccggccactactccctactggtccaggtgaagtctggccacggcccccaggaccactaattangatgcgaccaacagacactccgtggcgcccgtggtccgttttcgggcctcccctccgtcggggccaaacgctacgcctcgacccgtaacggggccgcgcgccgtgacggacgacggcccggaatacgttagttcgtacctactattactattgtagttgggtcggtcgttcgtcgtcccgttacgtttccgggcgggtccgggaccgacggggtcggtccggtcggtggtccgacgaccgacggtcgtcccgccccgtccgggtcctccgtccgtccgttccccggtccctcccgtcctacgtcctacgctcggcggccggg

SEQ ID NO: 390971 - DNA, 674 bp, Homo sapiens
  misc_feature: GZ8MTXP02FT9OF.17.75.G09.1.454.CMB.2.raw
  modified_base (166)..(166): a, c, t, g, unknown or other
  modified_base (267)..(267): a, c, t, g, unknown or other
  modified_base (404)..(404): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtgtccccgaggggggacagtcattctcacctgtcgcctccagcactggagaagtgacagcggccactatccctatcggttccaggtgaagtcncggccacggccccaggacactaattatgatcgacaccaacacgacactccgtgggccgtccgtcggttccggtttttcggcctcccgtccggtcggggaccaaacgcgtcgcccgtcgaccccggtaacgggggccncgacgccgtggacggacggacggaccgtaacttaatttaacgttcgaccttacttacttactagttttcgtagttggggttcggttcgttcgttcgtcccgttagtttccggggcgggtaccggggtacgcgggggtcgggtccccggttccggtcggggtaccgaccggacccgaacgggtccgtcccggcccccgttccgggtacctccgttccgttccgtccccgtcccctcccgtccgttacgtccgtacgtcgtcggcggcgggg

SEQ ID NO: 390972 - DNA, 671 bp, Homo sapiens
  misc_feature: GZ8MTXP02HHTEG.17.75.G09.1.454.CMB.2.raw
  modified_base (296)..(296): a, c, t, g, unknown or other
  modified_base (309)..(309): a, c, t, g, unknown or other
  modified_base (328)..(328): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgaggggggacagtcattctcacctgtgcctccagcactggagagtgaccagcggccactatccctactggttccaggtgaagtctggcccacggcccccaggacaacttaattangatgcgaaccaanacgaccactccgtgggccnccgttcgggttccgttttcgggcctccccgtccggtcggggaccaaacgcctcgcccctcggaccccggtaacggggccacgacggcctagggaacgggcgaggcccgattattagtcgtctactactctatttgtagtggtcggtcgtcgtcgtacccttaggtttccggcgggcgggaccggacggggttcggccggtccgtcggggtccgacggacccgaacggtccgtacccggtcccccgtccggtccgtaccgttcccgttcccggttcccccgtccccgttaaccccgttccccgttaaccgttcccgtacccggtccttacgggtcggtccgggg

SEQ ID NO: 390973 - DNA, 623 bp, Homo sapiens
  misc_feature: GZ8MTXP02HEI6K.17.75.G09.1.454.CMB.2.raw
  modified_base (296)..(297): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtgcctccagcactggagaagtgaccagcggccactactccctactggttccaggtgaagtctggccacggccccaggacacttaattannatgccgacaacagacactcgtggcgcctggtccgtttcggcctccgtccgtcggggccaaagctcgccctacgaccccgtaacggggccgtacgacgccgtagacgggacgacgggacccgacgttaattacgttacgtaccttactaattctatttgagttgggttggttcgtcgtcgtacccgtagttttccgggcggtcgggaccgtaggggtcggccggtcgtcgggtccgacgcccgaacggtccgtccgccccgtcggtcctaccgtccttccgtcccctccctccgtcccgtacgtccgtaacgtcgtcgacggccggg

SEQ ID NO: 390974 - DNA, 713 bp, Homo sapiens
  misc_feature: GZ8MTXP02F7UT6.17.75.G09.1.454.CMB.2.raw
  modified_base (293)..(293): a, c, t, g, unknown or other
  modified_base (321)..(321): a, c, t, g, unknown or other
  modified_base (393)..(393): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacaggtcattctcacctgtcgcctccagcactggagaagtgaccagcgccactactccctatggtccaggtgagtctggccacggccccaggacactaattangatgacaccaacagacactcgtgggccnccgtcggtccggtttttcggcctcccgtccggtcggggaccaagtctcgcccgtcgaccccggtacggggcncgacgccgtaggacggacggacggacccgtacttacttaacgttcgtaccttaacttattacgtagtttagtagttcgggtcggttcgttccgttccggtacccgttacggttttccggggccggggtaccgggggtacccggtacgggggttccgggtcccggttccgggttacggggttccgaccgaccccggtaacggggtcccgttcccgggtccccccggtttaccgggtacccgtaccgtttcccgttacccggtttccccctacccgtttcctcccgtttacgtccgtaccggtcgtacgggtcggtccgggg

SEQ ID NO: 390975 - DNA, 540 bp, Homo sapiens
  misc_feature: GZ8MTXP02JBPL6.17.75.G09.1.454.CMB.2.raw
  modified_base (316)..(316): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgagtctggccaggcccccaggacactaattatgatgcgacaacagacactcctggcncctggccgttttcggctcccctcgtcggggccaacgctcgccctgaccccgtaacggggcgcacgcctgaggacgacggccgactattatcgctactatcatttgagtggtgtcgtctcgccctagtttcggcggtcgggaccgagggtcggccgtcgtggtcacgccaggctcgccctcgtcactctcgttcccgcctccgtcctacgtctacgctcgcgcgg

SEQ ID NO: 390976 - DNA, 621 bp, Homo sapiens
  misc_feature: GZ8MTXP02GINO7.17.75.G09.1.454.CMB.2.raw
  modified_base (263)..(263): a, c, t, g, unknown or other
  modified_base (299)..(299): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcacggaaccctcactgagtgtcgtccccgaggggggacagtcattctcacctgtgcctccagcactggagaagtcgaccagccggccactactccctactcggttccnggtgaagtctggccacggccccaggacactaattangatgccgaaccaacagacacctcgtggccgcgtcggtccggttttcggccttccgccggtcgggaccaacgctcgcctgacccggtacggggcgcgcgcgtgcggacgacgggccactattactcgtaccgtactatctagttgtacgtggtcggttcgttcgtcgtacctcgtttcgggccggtacggggacgtacgggtcgggtcccgtacgggtcgcgtacgccgaacggccgtccggccccttcggtacctccgttccgttcccgttacccctcccgtaaccgttccgtacgtcctacgtcgtacggtcggtccgggg

SEQ ID NO: 390977 - DNA, 573 bp, Homo sapiens
  misc_feature: GZ8MTXP02H2RVM.17.75.G09.1.454.CMB.2.raw
  modified_base (290)..(290): a, c, t, g, unknown or other
  modified_base (311)..(311): a, c, t, g, unknown or other
  modified_base (386)..(386): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccgagggggacagtcattctcacctgtgcctccagcactggagaagtgaccagcgccactatccctatgtccaggtgaagtttggccaggcccccaggacactaactttangatgcgacaacagacactccnggcgcctggtccgtttttcgggcctccccgtccgtcgggggacaacgctcgtccctcgacccgtaacgggggccncgagcccgtaggacggaccggacggccgtacttaattagtcgtcctactatctatttgattggtgtcgtctcgccctagtttcggcgggcggaccgagggtcggccgtcgtgggtcacgccgagggcctcgccccgtcggtcactctcgtcccgcccttcctccgtacgtctacgcgtcgcgcggcg

SEQ ID NO: 390978 - DNA, 620 bp, Homo sapiens
  misc_feature: GZ8MTXP02GLE5V.17.75.G09.1.454.CMB.2.raw
  modified_base (165)..(165): a, c, t, g, unknown or other
  modified_base (268)..(268): a, c, t, g, unknown or other
  modified_base (288)..(289): a, c, t, g, unknown or other
  modified_base (291)..(291): a, c, t, g, unknown or other
  modified_base (304)..(304): a, c, t, g, unknown or other
  modified_base (309)..(309): a, c, t, g, unknown or other
  modified_base (313)..(313): a, c, t, g, unknown or other
  modified_base (380)..(380): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgccagggtccaattcccaggctgtggtgactcaggaaccctnactgagtgtgtccccgagggggacagtcattctcacctgtcgcctcagcacgtggagaagtcgaccagccgccactactccctagtcggttccaggtgagtcngccacgccccagacatattnnangacaacacagacnctcgnggcncgtggtccgtttcggcctccgtcggtacggggaccaacgctcgccgtacggaacccggtacggggcncgacgccgtaggaacggacgacggaccgtattattacgttacgactactattactagtttaggagttgggtcgttcgttcgtccgtaccgttacggtttccgggacgggtccggggacggtacgggggtccggtccggtaccggtgggtaccgacgaccggtaacgtcgtcccgtccccgtcggtacctcgtccgttcccgtccctccctccgtcgtacgtccgacgtcgacggtcgcgg

SEQ ID NO: 390979 - DNA, 626 bp, Homo sapiens
  misc_feature: GZ8MTXP02F02JT.17.75.G09.1.454.CMB.2.raw
  modified_base (271)..(271): a, c, t, g, unknown or other
  modified_base (298)..(298): a, c, t, g, unknown or other
  modified_base (570)..(570): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcacctgtcgcctccagcacgtggagaagtgaccagccgccactactccctagtcggttccaggtgacgtcncggccacgccccaggacacttaattanagatgaccgaccaaacacgactaccgtccgtgggccgcccgttcggtcccggtttttccggccttcccgtccggtcggggaccaaacgtccgtcgacccgtcggaacccccggtaacggggccgacgacgccgtaggaacgggacggacggaccgtacgtattactcgtacctatatctagttgagttggtcgtctcgtcgtccttagtttcggcggtacgggacgagggtcgccgtcgtggccgacgccgagccgtccgccccgtcgtccncgtcctcctccccgtaccctcccgtacctacgtccgtacgtccgtcggacgtccgg

SEQ ID NO: 390980 - DNA, 674 bp, Homo sapiens
  misc_feature: GZ8MTXP02JO7FR.17.75.G09.1.454.CMB.2.raw
  modified_base (302)..(302): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgaggggggacagtcattctcacctgtcgcctccagcactggagaagtgaccagcggccactactccctacgtcggtccaggtgaagtcgtggccacggcccccaggacacttaatttagngatcgaccaaccaacacgacaccgtcgtcgggccgtccgttcggttccgtttccggccctcccgtcggtcgggaccacgtccgtccgtcccgtacggacccggacgggcgcgtacgcgtaggacgggacgacgtaccgtagttacttacgtcgtacttacttactacgttagttgtagttcgggtcgttccgtacgtccgtccgttacggtttccggggcggggtaccgggtacggtacgggtccggtcccggttcggtcgggtaccgtaccggaccgacggtccgtcccggtccccgtcggtacctccgttcccgtcccggttcccccgtccttcccgtccgttaacgtccgtacgtcgtacggcggtcgg

SEQ ID NO: 390981 - DNA, 649 bp, Homo sapiens
  misc_feature: GZ8MTXP02FUNKH.17.75.G09.1.454.CMB.2.raw
  modified_base (202)..(202): a, c, t, g, unknown or other
  modified_base (272)..(272): a, c, t, g, unknown or other
  modified_base (297)..(297): a, c, t, g, unknown or other
  modified_base (329)..(329): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtcgtccccgagggggacagtcattctcncctgtcgcctcagcacgtaggagaagtcgaccaggcgaccactactccctagtcggttcaggtagagtcngccgacgcccagactacttaatacngatcgaccgacaacacgacacgtcgtgggccnccgtcggtcggttttccggcctccgtcggtcgggactaacgctcgcctcgacccggacgggcacgcgacgtagacgacggacgtccgtacttagttacttcgaccttatacgttctagtttcgaggttcggtacggttcgttctccggtaccgtttacgggtttccggggccgggtacggggtaccggtcggggtccggtccggtcggttcggaccgtacgacccggtaacggtccgtacccggtccccgttacggtcctccggttccgttaccgtcccccgtacctccgttacgtcgttccaccggtcgcgtcggacgg

SEQ ID NO: 390982 - DNA, 694 bp, Homo sapiens
  misc_feature: GZ8MTXP02F14OZ.17.75.G09.1.454.CMB.2.raw
  modified_base (166)..(166): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctnactgagtgtcgtccccgaggggggacagtcattctcacctgtgcctccagcactggagaagtgaccagcgccactactccctactggttccaggtgaagtctcggccacggccccaggacacttaattatgatgaccgacaacagacactcgtggctccgtggtccgttttcggcctccgtcggtcggggaccaagctcgcccgtacgaccccggtacggggcgacgacggtccgtaggacggacggacgggaccgtacttagttacgttcgaccttacgttatactagtttgtagttgggtcggttcgttcgttccgtcccgttcggttttacggggccgggtccggggtaacccgggcggggttccgggtcccggttccgggttacggggtccgtaaccgggaccccgtaacgggtcccgtccccggtcccccgttccgggtccctaccgttcccgttcccgttaccccctaccccgttcccgtacccgttacgtccgttaaccggtcgtaacggacggtccgggg

SEQ ID NO: 390983 - DNA, 740 bp, Homo sapiens
  misc_feature: GZ8MTXP02F5UML.17.75.G09.1.454.CMB.2.raw
tcagcgtagactagcacgaccggtgctcgatttagtatagacatcaggggctggcaccaggggtcccttccaatatcagcaccatggcctggactcctctctttctgttccctcctcacttgctgcccaggtccaattcccaggctgtggtgactcaggaaccctcactgagtgtcgtccccgagggggacagtcattctcacctgtcgcctccagcactggagaagtcgaccagccgccactactccctacgtcggttccgaggtgagtcgtcggccacggccccgaggactaacgttaattatgatcgacgaaccaacacacaccgtccgtcggcctccgtcggttccggtttttccgggcccttccccgtccggtaccggggtaccaaacggtccgtccggccccgtacggtaacccccgggtaaaccgggggtccgaccgtaacggcccggtacgggaacgggaaccgggaacgggtacccgtaaacgtttaagtttacttacgtaccttaacttacgttcttagtttagtaggttcgggtcgttccgttcgtccgtacccgttaggtttccgggcgggtacggggacggtacggggtcggtccggttccggtcgggtaccgaccgacccggaacggtcccgtcccggtcccccgtacggtacccgtctcccgttacccgttccccctaccccgttcccgttaccgtacgtcccgtacgtccgtaggccggtcggg

SEQ ID NO: 390984 - DNA, 623 bp, Homo sapiens
  misc_feature: GZ8MTXP02IL8I1.17.75.G09.1.454.CMB.2.raw
  modified_base (243)..(243): a, c, t, g, unknown or other
  modified_base (253)..(253): a, c, t, g, unknown or other
  modified_base (256)..(256): a, c, t, g, unknown or other
  modified_base (260)..(260): a, c, t, g, unknown or other
  modified_base (279)..(279): a, c, t, g, unknown or other
  modified_base (290)..(290): a, c, t, g, unknown or other
  modified_base (304)..(304): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcacggaaccctcactgagtgtcgtccccgagggggacagtcattctcacctgtcgcctccagcacgtggagaagtcgacagcgcactntcctatgtcngtnatcngcacgcccagacactattngatgcgacaanagacactcgcggcnccgtggtccgtttcggcctcccgtcgtcgggccaacgctcgcctcgacccggtacggggcgcacgccgtagacgggacgacggtccgtacttatacgttcgaccttacgtacttctacgtttgtagttgggtcgtccgttcgtccggtcccgttacggtttccggggccgggtaccggggaccggtcgggggtccggtccggttcggttcgggcaacggcccgacggtccgtcccggaccccgttcgtccgtaccgttccgttacccgttccctaacccttccgtccgttacgtcccgtacgtcgtcggacggtccggg

SEQ ID NO: 390985 - DNA, 679 bp, Homo sapiens
  misc_feature: GZ8MTXP02I0KDB.17.75.G09.1.454.CMB.2.raw
  modified_base (297)..(297): a, c, t, g, unknown or other
  modified_base (453)..(453): a, c, t, g, unknown or other
tcagcgtagactagcacgaccggtgctcgatttagtatagacatcaggggctggcaccaggggtcccttccaatatcagcaccatggcctggactcctctctttctgttcctcctcacttgctgcccagggtccaattccccaggctgtggtgactcacggaaccctcactgagtgtcgtccccgagggggacagtcattctcacctgtcgcctccagccacgtggaagagtcgaccagccgccactactccctatcggtccaggtgagtctcggccacggcccagacacttaattngatcgaccgaccaacacgacctacctcgtcgggcctccgtcggttccgttttccggcctcccgtcggtcggggacctaacgcctcgccctacggaccccggacggggtccacgcgccgtaggacggacgacggcctattattactcgtacctactnttactagtttacgagttcgggtcgttccgtttcgtaccgttccccgtttaacggtttcccggggccgggtaccggggtacccgtcggggtccggttccgtccggtacgggtccacgaccccgaacggtccgtccccggtccccgtacggtcctccgtccgtttacccgtccccctacccgttccgttacccgttacgtcccgttacgtcgtccggtacggcccggg

SEQ ID NO: 390986 - DNA, 559 bp, Homo sapiens
  misc_feature: GZ8MTXP01CYBXQ.4.52.E08.1.454.CMB.2.raw
tcagagcactgtagcacgaccggtgctcgatttagtcgagctctctcggcggggggcaggagtcagacccagtcaggacacagcatggacatggacgggtccccgctcagctccgtggggctcctgctgctctggttcccaggttccagatgcgacatccagatgacccagtctccatcttccgtgtctgcatctgtaggagacagagtcaccatcagttggcgggcgagtcgagggtatagcaaggtggtgctggtatcagacaagaaaccgagggaaacacccctaaatcctagatactatagaagcatccgtagtttagacgtaaaggtcggggtaccagtacgaaggttcaggcggacaggtggatcgtagggactagtactttcactctacaccatcagcagcctgacagcctaggtaatattttcggacttaaacttactactgtacaaacgacggtactaaactcgtttacccatcctaaccgttcggacccgaaagggaccaacgacgttaggaattaagttaaaccgatgtggcttacgccaacgtaacg

SEQ ID NO: 390987 - DNA, 611 bp, Homo sapiens
  misc_feature: GZ8MTXP01BVPEX.4.52.E08.1.454.CMB.2.raw
  modified_base (203)..(203): a, c, t, g, unknown or other
  modified_base (283)..(283): a, c, t, g, unknown or other
  modified_base (418)..(418): a, c, t, g, unknown or other
tcagagcactgtagcacgaccggtgctcgatttagtcgagctctctcggcgggggcaggagtcagacccagtcaggacacagcatggacatggacgggtccccgctcagctccgtggggctcctgctgctctggttcccaggttccagatgcgacatccagatgacccagtctccattcttccgtgtctgcatctgtaagganacagagtcaccatcacgttggcgggcagtcgagggttatagcaaggtggtgctggtatcagacaagaaaccagggaaacncccctaaaatcctagatactaatagaagtcagttccgtaagtttacgacgtaaaggtcgggtaccctaagtcgaaaggttcgaggtccggaataggtggatcgtagggaactagtactttcacttcacacctaancgacgcgacgtctacgacgacgtacgtacgtaagttagtttacgtaacttaacttaactactacgtacgtaacgtaacgtaactaacttacttaccttactcctaaccgtaccgaccgaacggacgtaacgtaacgttacgttagttaaacgtaaacgtaacgtaacgtacgtacgttactaacgaacgtaac

SEQ ID NO: 390988 - DNA, 573 bp, Homo sapiens
  misc_feature: GZ8MTXP01EJXLK.4.52.E08.1.454.CMB.2.raw
  modified_base (284)..(284): a, c, t, g, unknown or other
  modified_base (423)..(423): a, c, t, g, unknown or other
  modified_base (447)..(447): a, c, t, g, unknown or other
tcagagcactgtagcacgaccggtgctcgatttagtcgagctctctcggcgggggcaggagtcagacccagtcaggacacagcatggacatggagggtccccgctcagctcctggggctcctgctgctctggttcccaggttccagatgcgacatccagatgacccagtctccatcttccgtgtctgcatctgtaggagacagatcaccatcacttggtcgggcgagtcgagggttattagcaaggtggttggctggtatcagacaaggaaaccaagggaaacncccctaaactcctagatctatagaagcactcctagtttgacgtaaaggtcggggtacccatacgaaggttcaggcggacaggtggatagtgggactagtatttcactctcacatcagcacgcctgcagcctagaacgtntttacggacttaacttactacgtntacaacaggtaccttaacgtacctttaccctaactccctaaccgttcggaccgaaaggaccgaacgaacgttagggaacttaaacgttaaacgaacgttgtacggtacttacgtaacaacccgtaa

SEQ ID NO: 390989 - DNA, 628 bp, Homo sapiens
  misc_feature: GZ8MTXP01B7IB3.4.52.E08.1.454.CMB.2.raw
  modified_base (312)..(312): a, c, t, g, unknown or other
tcagagcactgtagcacgaccggtgctcgatttagtcgagctctctcggcggggggcaggagtcagacccagtcaggacacagcatggacatggagggtccccgctcagctccgtggggctcctgctgctctggttcccaggttccagatgcgacatccagatgacccagtctccatcttccgtgtctgcatctgtaggagacagagtccacatcacgttggcgggcgagtcgagggttattagcaggtggttggctggtatcgagacaagaaaccgaggaaacgacccctaaactcctgatactatagaancatcctagtttagacgtaaaggtcggggtacctacgtacgaaggttcgacggacggacgtaggtggtacgtcggtaggggactagtactttcaccttctacaaccagtcagcgacgtcctagccgaacgcctagtaacgttacgtttacggaactttaaacttactaaccgttgtaaccgaacgtacggtacctaaccgttaccgtttaccccttacttcccgtaacccggttcgggaccggtaaacgggacctaacggtaacgttaggaacgttaacgttaacgacgtggtacggcttagaaccttaacgtaacg

SEQ ID NO: 390990 - DNA, 637 bp, Homo sapiens
  misc_feature: GZ8MTXP01CEXOD.4.21.B10.1.454.CMB.2.raw
  modified_base (243)..(243): a, c, t, g, unknown or other
  modified_base (262)..(262): a, c, t, g, unknown or other
  modified_base (282)..(282): a, c, t, g, unknown or other
  modified_base (316)..(316): a, c, t, g, unknown or other
tcagagcactgtagcacgaccggtgctcgatttagtgtcgtcgcaagagaggagggggtgggctcaggaggcagagctctgggaatctcaccatggcctggacccctctcctgcctccccctcctcactttctgcacagtctctgaagcctcctatgagctgacacagccaccctcggtgtcagtcgtccccaggacaaacggccaggatcacctgctctggagatgcattgaacaaaaaatntgcttatggacagcagatnagcagcccaaatgcatctangaagacgaacaaacgaccctcgggactcctaganagatctccgtgctccagctaacgaggtctagtcggacctacttagacctatcgacggtcggggacccaaagggtggaagtagtaggaaagtcgtagaacttaaccgtattacgttaacctaacgaaagttaaggaacgaaagtagtaggaatttaaagtttccggtggggtacgttacggggacgggaacgggtaaacccgtaaacgttcggtaaacccgttaccgttaaacggggtaccaaccgggccccaaaggggtcccttaccccggaacccccgttcgggcccgttaaccctttcccgttccgttttcccccccgg

SEQ ID NO: 390991 - DNA, 623 bp, Homo sapiens
  misc_feature: GZ8MTXP01DGZBY.4.21.B10.1.454.CMB.2.raw
  modified_base (441)..(441): a, c, t, g, unknown or other
tcagagcactgtagcacgaccggtgctcgatttagtgtcgtcgcaagagagggggggtcccttagactctcctgtgcagtctctggactcaacctcaaaaatgcctggatgacctgggtccgccagactccagggaagggctgcagtgggttgccgtattataaccaaactgatggtgagacaacagactacgctgcacccgtgaaaggcagattcaccatctcaagagatgattcaaacgaacacgtcttgtttttaggaaatgaacagcctagaaaaccgagacacagtccgtttattctgttccacactccctgcctacagagtatttcgtagactataactcgcatatggacgtcgtggggacccaaaagggacccaagacgtccaccgtctccctacaacctcccaaccaacggccccagtccgtccttcccccgngggcccgtccctcgcctccgacggacgcccaccggtcccgaaggacgccaaccgacggcccggcccgtcggggcctcggcccgtcgggttaccaaacgggtcccttaacctttcccccgagtaacggttcgaccgttccgttgggaacgggcccgggtcgtcgggacgaacgggtcgctaag

SEQ ID NO: 390992 - DNA, 600 bp, Homo sapiens
  misc_feature: GZ8MTXP01DYBEY.4.21.B10.1.454.CMB.2.raw
  modified_base (527)..(527): a, c, t, g, unknown or other
  modified_base (569)..(569): a, c, t, g, unknown or other
tcagagcactgtagcacgaccggtgctcgatttagtgtcgtcgcaagagagggggggtcccttagactctcctgtgcagtctctggactcaacctcaaaaatgcctggatgacctgggtccgccagactccagggaagggctgcagtgggttggccgtattataaccaaactgatggtgagacaacagactacgctgcaccgtgaaaggcagattcaccatctacaagagatgattacaaacgaacacgtcttgtttttaggaaaatgaaacagacctagaaaaccgaggacacagtccgtttatttctgttccacactccctgccctacagagtatttcgtgtactataactcgacatagtggacgtcgtggggacccaaaaggggacccaacgagtcccaacccggtcctaccgtaccaaccctcccaacccgaaacggggcccctaagtcccgggttccttcccccgtcgggcccgtcccctgcctccgaggacgccaccgtcccgagacgcacgcgccggccnggggcctggcctcgggacaaaggtcttactcccttagcgtcncgttcttggcgtcggctgggcaggcgcgaag

SEQ ID NO: 390993 - DNA, 602 bp, Homo sapiens
  misc_feature: GZ8MTXP01BJHBK.4.21.B10.1.454.CMB.2.raw
tcagagcactgtagcacgaccggtgctcgatttagtgtcgtcgcaagagaggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaaacgaacacgcttgtttttaggaaatgaacagcctagaaaaccgaggacacagtccgtttatttctgttccacactccctgcctacagagtatttcgtggactataatcgcatactggacgtcgtggggacccaaaaggggacccaacgagtccacccgtctccctaccaaccctcccaacccgaacgggcccctacgtcccggtcccttcccccgtggcccgccctgcctccgaggacgccaccgtccgagacgccacgcgccggcccgtgggcctcggcccgtcggtacgaacgtaccttacctcccagtacgtcgttcgttcgttacggcgggccgggtcgtcggacgacggcgcgtaag

SEQ ID NO: 390994 - DNA, 675 bp, Homo sapiens
  misc_feature: GZ8MTXP01DSKML.4.21.B10.1.454.CMB.2.raw
  modified_base (224)..(224): a, c, t, g, unknown or other
  modified_base (251)..(251): a, c, t, g, unknown or other
tcagagcactgtagcacgaccggtgctcgatttagtgtcgtcgcaagagaggaggggggtgggctcaggacgcagagctctgggaatctcaccatggcctggacccctctcctgcctccccctcctcactttctgcacagtctctgaggcctcctatgagctgacacagcccaccctggtgtcagtcgtccccaggacaaacggccagatcacctgctctgganatgcaagttagaaacctaaaaaaaatntagtactttagttaggtaaccagacaagaagtcgacggaccaacggacccctaaaagttggtacatactatagaaacgaaccgaacaaaccgacccgtccgggaactcccgtagaacgagtacttcgtccgtacggctccagcctaacgagggtaactagtcggaccctaccgtgactagtcgtaggtcgggacctaaaggtgggaagtagtaggacgtacgtacgaacttaactacttagttaacctacgaaagtaggaaagaaacgtagttagaagtttaacgtttcggtacggggttaggttacgggacgggaaacgggtaaacctaaacgttaccggtacccgttaccgttacgcgttaccgccgttaacgggtcctacccgtccccgttcggtacttccgttaaccttccgtaaccccc

SEQ ID NO: 390995 - DNA, 601 bp, Homo sapiens
  misc_feature: GZ8MTXP01CQEAM.4.21.B10.1.454.CMB.2.raw
  modified_base (243)..(243): a, c, t, g, unknown or other
  modified_base (245)..(245): a, c, t, g, unknown or other
  modified_base (254)..(255): a, c, t, g, unknown or other
  modified_base (259)..(260): a, c, t, g, unknown or other
  modified_base (276)..(276): a, c, t, g, unknown or other
  modified_base (279)..(279): a, c, t, g, unknown or other
  modified_base (281)..(281): a, c, t, g, unknown or other
  modified_base (329)..(329): a, c, t, g, unknown or other
tcagagcactgtagcacgaccggtgctcgatttagtgtcgtcgcaaggaggagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggcaggatcacctgctctggagatgcattgacaaaaaaaatntnatatgacannagannagacagaccaaatganatnanagaagacgaacaacgaccgtacggactccagagatattctctgctcancacgagcgtagtacgactactacgactatacgagtcggacgagaggaggagtagaagagtagacgtaactaacttagttaacgtaacgtaaagtaaagtaaacgaaacgtaagtaagtaagttaagtttaacgttagggttaggttacgggtacgggtaacgggtaaaccgtaaaccgttaacggtaaccggttaccggtaacggtacgttacgaccgaaccggtaaccgtaccgtccccgtcccgtaccgttacctccgttccgttccccg

SEQ ID NO: 390996 - DNA, 671 bp, Homo sapiens
  misc_feature: GZ8MTXP01EXNA2.4.21.B10.1.454.CMB.2.raw
  modified_base (248)..(248): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagccgaccctcggtgtcagtcgtccccaggacaaacggccaggatcacctgctcgtggagatgcattagaaccaaaaaatntgtacttattggaccagcagaagtcaggccacggaccccaaaagttggacatctaatagaagaaccgaacaaaccgaccccgtacccgggactccccgtagagagtacttctccgtggctccgagcctaacgagggtctagtcggaccctaccgttgactagtcgagggtcgggacccgaaggtgggagagtagaagtcgtagaaccttactacgttagttaactacgtaaagttaacggaaagtaacgtaagttagtaagttttaaacgttttcggttgggggttcggttaccggggacggggtaacgggtaaacccgtaaacgttcgggtaacccgttacgtacgggtaccgacggcccgttaacgggtccctacccgcccccgttcggtaccttaccgttcccgttcccgttaacccccc

SEQ ID NO: 390997 - DNA, 787 bp, Homo sapiens
  misc_feature: GZ8MTXP01CIWPC.4.21.B10.1.454.CMB.2.raw
  modified_base (251)..(251): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgctaattacgaaccaaaaaaatntagtacttattacggtaccagcaagaagtcaggaccaacggacccctaaaagttcggtaccaattctaataggaaagaaccgaacaaaccgtcccctaccgggactccccgtagacgagtacttctaccgtcggctccgagtcctaacgaacgggtaactagtccgggaccctaacccgtttacggaacttaacgtaccgtaacggggttacgggggaaccccgtaaagggttacgggggaacggtaacggttagggaaaacggtccgtaacgggttaaaccgttaacctttaaacccgttaaggttttaaaccccgtaacgttaaaagtttaaagggtaaaccggaaactaaaggggttataaacgttttaagttttaaccggttgggggttacgggttttacggggaccgggttaacggggaaacccgtaaacgttccgggtaacccgttaccgtaacggttaccgacggccccgaaacggtccgtacccgcccccgttcggtacccttacgttcccgttccgtttaacccccc

SEQ ID NO: 390998 - DNA, 752 bp, Homo sapiens
  misc_feature: GZ8MTXP01CAW4T.4.21.B10.1.454.CMB.2.raw
  modified_base (225)..(225): a, c, t, g, unknown or other
  modified_base (245)..(245): a, c, t, g, unknown or other
  modified_base (270)..(270): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctgganatgcattagaacaaaaaatntgacttatggtaccagacagaagtnacggccacggacccctaaaagttgacatactatagaaacgaccgaaacaaaccgtaccccgtacgggaactcccgtagaagtacgtactttctcccgtggacctccgaacgtccgttaacgaacggggtaacctagttaccgggaccctaacccgttagaaccgttaaacgtcccgtaaggggttacggggtaccccgaaagggttacgggaaggaagttacggaaagtcgtaacggtaaccttaacgttaacttaacggtttaacctaaccggtaaaagttaaaggttaaaccgaaaacgtagtaacggtaaactttaaacgttttcgggtaaggggtttcgggttacgggtacgggaaacggggtaaaccctaaaacggttcgtaaacccgttccgtaaaggtccgaccggacccgaacggtcccgtcccgtcccccgttcggtacccgttacccgttccgtttcccgtttaaccccccg

SEQ ID NO: 390999 - DNA, 659 bp, Homo sapiens
  misc_feature: GZ8MTXP01ETYHP.4.21.B10.1.454.CMB.2.raw
  modified_base (211)..(211): a, c, t, g, unknown or other
  modified_base (249)..(249): a, c, t, g, unknown or other
  modified_base (399)..(399): a, c, t, g, unknown or other
  modified_base (499)..(499): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggancactgctctggagatgactattagaacctaaaaaaatntagtacttattggtaaccaggcaaggtaaacgtcgaacgggacccaacgggaaccccctaaaagttcggtacaatactaagtagaacgaacgaaacgaaaccgacccgtcgggactcccgtagacggtactctcgtaccggctcacgacncgaacgagtcgtacgtcgaccctcgtaacgtgtcgaacggttcgggccggtaacgtaggggaggtaagtagtaacggacgttatacgtaactaccggttnttacgtaacaaggtaacgaaggtaactaagtagtaattaagtttatcggggttggtacgggtacggacgggtaacaaaccgtgttccgaacgttcgtaacgtcgaccgcccgagttccgccccgttccgtaccgtcttcccgttccgttccccgtccccg

SEQ ID NO: 391000 - DNA, 655 bp, Homo sapiens
  misc_feature: GZ8MTXP02INZ1B.4.21.B10.1.454.CMB.2.raw
  modified_base (246)..(246): a, c, t, g, unknown or other
tcagagcactgtagcacgaccggtgctcgatttagtgtcgtcgcaagagagagaggagggggggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctggagatgctattgaaccaaaaaatntgtacttattcggtaaccagacagaagtcaggacccaaggacccccaaaaagtttcggtacagttactatagaaacgacgaacaaaccgaccccgtcgggactccccgtgagaagtacttcctacgtggccctaccagtccttacgaggggtactacgtcgggaccctacccgttgaaccttatacgaggtccggggtacccaaagggtcggaaggataggaaagtcgtacgaactacgtacttacgtttaactacgtaaatagaagaaactagtagtaaagttaagtttacggtgggttacggttcgggacgggtaacggaaccgtaaaacgtcggtaacccgtaccgtacggtaccgacgtacccgaaggtcctaccgacccccgttggtacctaccgtcttccccg

SEQ ID NO: 391001 - DNA, 526 bp, Homo sapiens
  misc_feature: GZ8MTXP02F9C8B.4.21.B10.1.454.CMB.2.raw
  modified_base (415)..(415): a, c, t, g, unknown or other
  modified_base (428)..(428): a, c, t, g, unknown or other
tcagagcactgtagcacgaccggtgctcgatttagtgtcgtcgcaagagaggggtcccttagactctcctgtgcagtctctggactcaacctcaaaatgcctggatgacctgggtccgccagactccagggaagggctgcagtgggttggccgtattataaccaaacctgatggtgagacaacagactacgctgcacccgtgaaaggcagattcaccatctcaagagatgattcaacgaacacgctgttttggaaatgaacagcctgaaaaccgaggacacagccgttatttctgttccacactccctgcctacagagatttcgtgactataaatcgccatatggacgtctggggccaaaggggaccacagtcaccgtctcctcaacctccacaaggcccatcgctcccctgccncctgctccaggancacctccgagagcacacgcggccctgggctgccctggtcaaacggactacttccctaacgcgtcgctcgtgaacggcgggctcggacgacggcgacag

SEQ ID NO: 391002 - DNA, 592 bp, Homo sapiens
  misc_feature: GZ8MTXP02G1RMU.4.21.B10.1.454.CMB.2.raw
tcagagcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattacaacgaacacgcttgtttttaggaaatgaacagcctagaaaaccgagacacagtccgtttattctgtccacacctccctgcctacagtagtatttcgtgactataatcgcatactggacgtcgtggggaccaagggaccacgacgtccaccgtcctacctaccaaccctcccaacccgaacgggccccctagtcccggtcccttcccccgtggcccgccctcgccctccgacggacgccacctccgagacgccacgacgccggcccgtgggctcggccgtgggtacaaacggccttaccttaccccgtacgacgtcgacctcgtggaacggcgggcgtcggacacggcacgag

SEQ ID NO: 391003 - DNA, 644 bp, Homo sapiens
  misc_feature: GZ8MTXP02F6FNI.4.21.B10.1.454.CMB.2.raw
  modified_base (182)..(182): a, c, t, g, unknown or other
  modified_base (250)..(250): a, c, t, g, unknown or other
  modified_base (356)..(356): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagcccaccctcggtntcagtcgtccccaggaccaaacggccaggatcacctgctcgtggagatgctattagaaccaaaaaatntgcttattggtaacagcaagaagtcgaggaccaggacccctaaaattggacatactatagaacgaacgaaccaaaaccgccccgtacgggactcccgtagagagtnttctccgtcgcctcagctacgagggctatcggacctaccgttgaactatcgagggtccgggaccctaagggtcgggaggataggacgctacgtactacgtacttagttaactactaagtaagagtaaacgtagtagtaatttaagttcggttaggggttcgtacggggtacgggaacggtaaacctaaacggttcgtacccgttacggtaacggtacgaaccgtacccggtaaggccgtacccgtcccccgttacggtcctacccgttccgttcccgtttaccccccg

SEQ ID NO: 391004 - DNA, 607 bp, Homo sapiens
  misc_feature: GZ8MTXP02FWGZX.4.21.B10.1.454.CMB.2.raw
tcagagcactgtagcacgaccggtgctcgatttagtgtcgtcgcaaggggtagaagcctttgaccaggcaggtcaggctgacctggttcttggtcatctcctccccgggatgggggcagggtgtacacctgtggttctcggggctgccctttggttttggagatggttttctcgatgggggctgagctggattttccttttggctattttcaaaggtgtccagtgtggagtgcagctggtggagtcgtgggggaggcttggtacagcctggcaggtccctgagactctcctgtgcagtctctggattcacgtttggtgaatatgccatgcacgtgggtccgacaagctccgaggggaacggcctggagtcgggtctcgagggttagttcggtgggtagtggggtacgaaaccgacgagggctaagtggccggactcgtgtaggaacgggtccgattccgacctacgtcctaccaaggacgaacaaccgaccaaacgaacccgttcccttagtttcctacgaacctaaagtgaactacgtcgtagagagcgtagacggacacggccgttagtaacttacgtaggtaacggtaaaacggcgtaaacccg

SEQ ID NO: 391005 - DNA, 816 bp, Homo sapiens
  misc_feature: GZ8MTXP02FTXVU.4.21.B10.1.454.CMB.2.raw
  modified_base (250)..(250): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgctattacgaaaccaaaaaaatntagtactttagttcggtaaccagacaagaagtcgaacggacccgaacggaaccccctaaaagttcggtacaattactaagtaacggaaacgaaccgaaaccgaaaacccgaccccgtaccggggaactccccgtagaacgagtaacttcctccgtcggcctacgacgtcctacggaacgggtaccttacgtaccggtaccctacccgttacgtaaacttacgtcgtaaacgggggttccgggggaaacccgtaaaggggttacgggaaggtaagttaggaacgtcgtaacggtaaccttaaactacgtttacgttaaacctaacgtaaaagttaaggaacgtaaaacgttaagttaaacgttaatttaaacggttttccgggtaagggggtttcgggtaccgggggtacgggtaaaccgggtaaaacccgtaaacggtacccggttaacccggttaccggttaacggtacccgtaaaccggacccccgggtaaacgtcccgttcccccggtacccccggttacggtacccctaccgtttccccggttccccggtttaacccccccg

SEQ ID NO: 391006 - DNA, 655 bp, Homo sapiens
  misc_feature: GZ8MTXP02FYPSB.4.21.B10.1.454.CMB.2.raw
  modified_base (252)..(252): a, c, t, g, unknown or other
  modified_base (457)..(457): a, c, t, g, unknown or other
  modified_base (497)..(497): a, c, t, g, unknown or other
  modified_base (504)..(504): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggactcacctgctcgtggagatgcattacgaaacctaaaaaatntgtactttaagttcggtaaccagcaagaacgtcgacggacccaacggaacccctaaaagttcggactatactaagtacgaaagaccgaaacaaaccgacccgtaccgggactcccgtagaagagtacttcctcgtcgcctaccgagtctacgacgggtactacgtccggacctaccgttgactatcgagggtcggacctaagggngaggatagactcgtagtactactacttagttacacgtaanaggtaanaacgtagtagttaattaaggttcggttaggggtcgttcgggacgggaacgtaaccgtaaacgtcggtacccggtacgttacggacctaacggcccgtaaggtccctaccccgtccccgtcggtacctaccgtcccgtttcggttccccccg

SEQ ID NO: 391007 - DNA, 792 bp, Homo sapiens
  misc_feature: GZ8MTXP02GXE61.4.21.B10.1.454.CMB.2.raw
  modified_base (311)..(311): a, c, t, g, unknown or other
  modified_base (336)..(336): a, c, t, g, unknown or other
tcagagcactgtagcacgaccggtgctcgatttagtgtcgtcgcaagagagggggggtcccttagactctcctgtgcagtctctggactcaacctcaaaaatgcctggatgacctgggtccgccagactccagggaagggctgcagtgggttggccgtattataaccaaacctgatggtgagacaacagactacgctgcacccgtgaaaggcagattcaccatctcaagagatgaattcaacgaacacgcttgttttaggaaatgaacagcctagaaaaccgaggacacagtccgtttattctcgtccacncctccctgcctacagagtatttcgngacttataactcgacctatactcgggacgtcgtacggggaccaaacggggtacccacgtacggtaccgtaaccccggttccttacccgtacctaaacccccttacccgaaacccgtaaaccgggggtcccccctaaaggttcccccggggtttaccccctttcccccccggtcgggggacccccgtcccccggttcgaccccgttaccccggaacgggtaaacccggcccccgtaaaccccgttccccggggaaagtacccggacccgaaccggaacccggtccccggggccccggttcgggggcctttcgggaccccggttacggggttaacccggaaaacgggttacccctttaacccgttacccccgttaaacggacggttccgtacccgttcggtacggaaccggggtcccggggcgttacggggaccggtaacgggcccggtacctaaagg

SEQ ID NO: 391008 - DNA, 736 bp, Homo sapiens
  misc_feature: GZ8MTXP02JYTPN.4.21.B10.1.454.CMB.2.raw
  modified_base (220)..(220): a, c, t, g, unknown or other
  modified_base (224)..(224): a, c, t, g, unknown or other
  modified_base (246)..(246): a, c, t, g, unknown or other
tcagagcactgtagcacgaccggtgctcgatttagtgtcgtcgcaagagaggaggggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctcngganatgcattacgaaccaaaaaatntgtacttagttggtaccagcaagaagtcgaggaccacggaacccctaaaagttggacatctatagaacgacgaacaaaccgaccccgtacgggactcccgaggacgagtattctccgtcggctccgacgtctacgtacgggctacgtcggaccctaccgttagtaaccttagtacgacggggttcggggaccccgtaaaggggtacgggaaaggacgtacggaacgtcgttagtaaccgttaacttacgttacgtttaactaacgtaaagttaacgaacgtaaacgtagttagtaagttttaacggtttcggttacggggttacgggttaccggggacggggtaaacgggtaaacccggtaaaacgttaccggggtaacccgttaccggtacgggttacccgaaccggtaccccgtaaacgggcccgttaccccggtacccccggttccggtaacccgttaccgtttcccgttacccggtttccccccgg

SEQ ID NO: 391009 - DNA, 705 bp, Homo sapiens
  misc_feature: GZ8MTXP01BK6K5.51.21.B10.1.454.CMB.2.raw
  modified_base (226)..(226): a, c, t, g, unknown or other
  modified_base (291)..(291): a, c, t, g, unknown or other
tcagcgatcgtatacacgaccggtgctcgatttagtgtcgtcgcaagagaggagggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattcgaccaaacgatatgcttattggtaccagcagaagccgggccaggccctgtgttggngatgtaataaagacacgtgagacgccctgagggactcccgtgagcgacttctgtcggctcgaaggtcaagggacaacgggtcacgtattcgggacctatacgaggttacggacggtacccgaagggacgaacggggaacgggaacgggaacgggtacccgttaaggaaaccggtttaaacttttaagtttacggggttaaaccgtaaaacttaacccgaaaacttaaacggaaccctaaacccgttaagtttaccgggtttaaactttaacgttcggttaccgtttacgggtaaaacgttcggacccgaaacccgttaaagggtcccgtaacccggttccggttcgggggttaccaaccggaccccgtaaacgggacccccaaccccggttacctaacccggttcctaaccccg

SEQ ID NO: 391010 - DNA, 691 bp, Homo sapiens
  misc_feature: GZ8MTXP01DHQUE.51.21.B10.1.454.CMB.2.raw
  modified_base (227)..(227): a, c, t, g, unknown or other
  modified_base (245)..(245): a, c, t, g, unknown or other
  modified_base (288)..(288): a, c, t, g, unknown or other
tcagcgatcgtatacacgaccggtgctcgatttagtgtcgtcgcaagagaggagggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacaggacggccaggatcacctgctctgganatgcattcgaccaaacgntatgcttatggtacagcagaagccggcacggccctgtgtggtnatagtaataaagacactgagacgccctacgagggactccgtgacgcgtattctcgtggcctacgaagggtcgaacgggaacgtaaacgggtactaacgtagttcgggaccagtacgtaggtacggacgtaccgaagggcgaaaggacgggaacggacgggtacgttacgtaaacttaagtttaacgtttacggggtaaactaaaacgttaaccaaaacggaacgtaaaccgtaaccttaagtttaacgggttaaaccttagttacgtttaccgttaacggtaacgttcggaaacccgtaaaccgttaacggtacccgtacccggttaccgttcggggacccaaccggtaccccgaaaccggtaccccgaaaaccccttcgtaaccggttaacccttaaccccg

SEQ ID NO: 391011 - DNA, 704 bp, Homo sapiens
  misc_feature: GZ8MTXP01DZZSA.51.21.B10.1.454.CMB.2.raw
  modified_base (80)..(80): a, c, t, g, unknown or other
  modified_base (241)..(241): a, c, t, g, unknown or other
  modified_base (286)..(286): a, c, t, g, unknown or other
tcagcgatcgtatacacgaccggtgctcgatttagtgtcgtcgcaagagaggaggggggtgggtccaggaggcagaactntgggtgtctcaccatggcctggatccctctacttcctccccctcctcactctctgcacaggctctgaggcctcctatgagctgacacagccaccctcggtgtcagtcgtcccaggacagacgccaggatcacctgctctggagatgcattcgaccaaacgntatgcttattggaccagcagaacgccggcacggccctgtgttggngatgtaataaagacacgtgagacggccctgagggactcccgtagagcgtacttctcgtggctccgaagggtacgaaggggacaaacgggtcaacgtagttcgggacctaatccgaggtacgggacgtccgaagggcgaaagggacgggaacgagggtactaggtaaacttagtttaattcggggtactaaacgttacaaaacgaacgaacctaacccttaagtttaacgggttaacttaacgttacggttacccgttaacgggtaaaaccgttcggaacccggtaaacccgttaaacgggttccccgtaaaccccggttcccggttacgggggttacccaaacccgggacccccgtaaaaccggggaccccctaaaaaccccccggttctttaacccgggttaaccctttaaccccgg

SEQ ID NO: 391012 - DNA, 766 bp, Homo sapiens
  misc_feature: GZ8MTXP01A64XJ.51.21.B10.1.454.CMB.2.raw
  modified_base (228)..(228): a, c, t, g, unknown or other
  modified_base (251)..(251): a, c, t, g, unknown or other
  modified_base (297)..(297): a, c, t, g, unknown or other
tcagcgatcgtatacacgaccggtgctcgatttagtgtcgtcgcaagagaggagggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctcgtgganatgactagttcgacccaaacgtntatgacttatggtaccagcaagaagcccggcacggccctgtgttgngatgtaataaagcacgtgagacggccctagagggtactcccgtgacgcgtacttccgtcgtcggctcccgaaagggtccgaaggggaccaaacgggtcaacgtagttacgggacctattacgaggttacgggagtacccggaaggccgaagggaaacggggacggacgggtaccgtaggtaacctttaaagttttaacgtttcggggtaaactaaaagttaaccctaaaaccgtaaacggaaaccctaaacccgttaagttttaaccggggtttaactttaaacgttccggtttaccgttttaaaccgggaaacgtttccggaaccgggtaaacccgttaaacggggttaccccgttaaaccccgggttccggttaccgggggttaccaaacccgggtcccccggtaaaaaccggggacccccccgtaaacccccttaaccggttccgttaaccccgttttaacccccg

SEQ ID NO: 391013 - DNA, 645 bp, Homo sapiens
  misc_feature: GZ8MTXP01C68Z4.51.21.B10.1.454.CMB.2.raw
tcagcgatcgtatacacgaccggtgctcgatttagtgtcgtcgcaagagaggagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaacgatatgcttatggtacagcagagccggcagccctgtgtgtgatgtaataaagacactagagacggccctagagggactcccgtgacgcgtacttcgtctggcctccgaagggtcgaaggggaactaaccgggtacaacgtagttcgggacctagtcgaaggtcgggaacgtccgaaggacgaagggacgggacggagggctagtaacttaatttagttagggttaacaaattaaccgaaactaacgaaccctaaccgtagtttaacggttactttaagtcggttaccgttacggaaacttcggaaccgtaaacccgaacggttacccgacccggttaccggttcgggttaccgaaccgaaccccgaacggtacccccaaccccgttactcgttccctaacccg

SEQ ID NO: 391014 - DNA, 628 bp, Homo sapiens
  misc_feature: GZ8MTXP01EPAHJ.51.21.B10.1.454.CMB.2.raw
  modified_base (225)..(225): a, c, t, g, unknown or other
  modified_base (243)..(243): a, c, t, g, unknown or other
tcagcgatcgtatacacgaccggtgctcgatttagtgtcgtcgcaagagaggaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgaccaaacgntatgtcttagttggtacagcagaacgccggccacggtccctgtgtgtgatagtaataaagacatgagacggccctagagggtactcccgtagacgtcgtacttccgtcgtcggccttacccgaacgggttacgaacggggaacctaacgggtcactagttcggacctagtacgagtggacgtccgaggcgaaggaggacgaggcgtagaacttaattagttacggtaactaaataccgaaacacgtaaacctaaccgttagtttacggttaccttagtaccgttacgtttacggaaacttcggaccgaaccgttaacggtcccgtaacgttccgttggaccaacgacccgaaccggacccaacccgttactccgttcgtaacccc

SEQ ID NO: 391015 - DNA, 632 bp, Homo sapiens
  misc_feature: GZ8MTXP01BV0GK.51.21.B10.1.454.CMB.2.raw
  modified_base (243)..(243): a, c, t, g, unknown or other
tcagcgatcgtatacacgaccggtgctcgatttagtgtcgtcgcaagagaggaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaacgntatgcttattggtaccagcagaacggccgggccacggccctgtggttggtgatgtaataaagacactggagacggccctgagggactcccgtgagcgacttctcgtggccttccgaaggtcgaagggacaaaccgggtcaacgtagttcggacctaatccgaggtcgggacgtccgaagggacaagggaacgggacgacgggactacgtaacttagtttacgttaggtactaagtaccaaacgtacgaactacctagttagtacctttagtcgttacgttcggaacgtcgaccggtaaccttaaagggtccctaaccggttccgttcgggttaccaaccggaccccgtaacggacccctaaccccggacttccggttccgttaaccccg

SEQ ID NO: 391016 - DNA, 753 bp, Homo sapiens
  misc_feature: GZ8MTXP01CKE2G.51.21.B10.1.454.CMB.2.raw
tcagcgatcgtatacacgaccggtgctcgatttagtgtcgtcgcaagagaggagggggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggactcacctgctcgtggagatgctattcgacccaaacgatatgtcttagttcggtaccagacgaaggaacggcccgggtacccgacggtccccgttggttcggttggtagtaagttagtaaataaaagacctaacgtaggaacgggacggtacccccgttacggaacgggggtaccttaccccgtaggacggtaccgttacgtttccgtcggttcggtccctacccggtaaacggggttaccggaacggggtaaacccgtaaaccgggtccgtaacgtaggttaccgggacctaaacgtcgtacggttgggaacgtccgaacgggacgaagggaacgggacggacgggtacgtagtaactttaagttacgtttacgggtaactaaattaaccaaacgaacgtaacctaacgttagtttacggttaaccttagttacgttcggttaacggtaacttcggaacgtaaccgttaacgttacccgtaccgttaccggttcggaccgaaccgacccgaacgacccctaaccgaccgtcgttcccgtaaccg

SEQ ID NO: 391017 - DNA, 532 bp, Homo sapiens
  misc_feature: GZ8MTXP02GLBG1.51.21.B10.1.454.CMB.2.raw
  modified_base (238)..(238): a, c, t, g, unknown or other
  modified_base (278)..(278): a, c, t, g, unknown or other
  modified_base (290)..(290): a, c, t, g, unknown or other
  modified_base (304)..(304): a, c, t, g, unknown or other
  modified_base (434)..(434): a, c, t, g, unknown or other
tcagcgatcgtatacacgaccggtgctcgatttagtgtcgtcgcaagagaggagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcagccctgtgtgngatgtataaagnactgagaggccctnaggggactcccgtgagcgattctctggcttccaggtcaggggacaaacgggtcaacgtagttcggaccatccgagttcggagtccagggcaggacggacgagggctagactaattagtgtacaatcaaanagaacacctattggtacttatgtacgttacgaactgaccgacgaacggtcaccgtacctgggtacaacgacccaacggcccaacccactacgtctacc

SEQ ID NO: 391018 - DNA, 671 bp, Homo sapiens
  misc_feature: GZ8MTXP02HROF5.51.21.B10.1.454.CMB.2.raw
  modified_base (139)..(139): a, c, t, g, unknown or other
tcagcgatcgtatacacgaccggtgctcgatttagtgtcgtcgcaagagaggaggggggtgggtccaggaggcagaactctgggtgtctcaccatggcctggatccctctacttcctccccctcctcactctctgcacngctctgaggcctcctatgagctgacacagcccaccctcggtgtcagtcgtccccaggacaggacggccaggatccacctgctcgtggagatgcattgacccaaacgatatgtcttagttcggtaccagcaagaacggcccgggccacggtcccctggtggttggtgattaggtaataaagactaacgtggaacgacggtccctacggaagggtactccgtaggacgcgtacttccgtcgtcgccttcggacggtcgacggggtacctaaacgggtctaaccgtagttacggacctaatcgtagggtacgggtacgtaccggacgggacgaagggacgggaacggtacggggtacctaggtactttaagtttactttgtaactaactacaaacgtacaacctacgttaagtttacggttactttagtcgttacgttaccggtactacggtaccgaacgtaacggtcctaacccgtcgttaccggacctaacggacccgtaacggaccccaacccgttacgtactacctacccg

SEQ ID NO: 391019 - DNA, 586 bp, Homo sapiens
  misc_feature: GZ8MTXP01DPP7B.44.62.F07.1.454.CMB.2.raw
  modified_base (285)..(285): a, c, t, g, unknown or other
  modified_base (380)..(380): a, c, t, g, unknown or other
  modified_base (397)..(397): a, c, t, g, unknown or other
  modified_base (550)..(550): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggggcctgattcggcctgggaggtccctgaccctctcctgtgcggcctctggattcacctttagngcctatggcatgacctgggtccgccgggctccgaggggaggggactggagtggggtctcaagtatcgggagctggtggtgtcactttccacgganactccgtgaaagggccncttcacatttccagggacaattcgcaggacaaattgtttctaccaaatacgaaaacctgagacccgagacacagggcgtctattactgttagaagccaggaccacggtccgacccccatcgacacctttagttacgttcggggccggggacgnggttggtgaccgtctcttcacgtccttccgaacccg

SEQ ID NO: 391020 - DNA, 650 bp, Homo sapiens
  misc_feature: GZ8MTXP01BPTWF.44.62.F07.1.454.CMB.2.raw
  modified_base (283)..(283): a, c, t, g, unknown or other
  modified_base (400)..(400): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgtggagtcgtgggggggcctgattcggcctgggaggtccctgaccctctcctgtgcgcctctggattcacctttagngcctatggcatgacctgggtccgccgggctccgagggagggactggaggtgggtctacgaagtagtcgggagcgtggtggtgtcactttccgacggagacgtccgtgaaacgggccncgttcacctatttccgagggacaaagttcgacaggactaaattcgtttactaccgtaaaatacgaaaaacctgaacgacccgagacacgaggggctacgtattacgttgttagaaacgcgaacggacctaccggtaccgacccccataacggtaaccttaccgttttaacgacggtttcgggggaccggggttacgttggttcgggtcgtacccggttcttccgttccgacgtcccgttcccgaacccgg

SEQ ID NO: 391021 - DNA, 697 bp, Homo sapiens
  misc_feature: GZ8MTXP01DYQEE.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtctttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccgggctccgagggagggactggagtgggtctcgaagtatcgggagcgtggtggtgtcacttttccgacgggagtaccgtccggtggaaaacggggcccgtcgttccaaccctattttaccccgagggggtaacctaaagtttccgcaagggaacctaaaattgtttactacccaaaatacgaaaaaccctgaacgaaccccgaaggaacaacgaggggacgttactaactttactagtttagaaacgccgtaacggaccctacggtaccgaccccccagtaacgaaccttaccgtttaacggttacgtttacgggggccgggggaccgagggttcgggtcggtaacccgttcgttccgttccgaaccggtccccttcccgaaaccccggg

SEQ ID NO: 391022 - DNA, 595 bp, Homo sapiens
  misc_feature: GZ8MTXP01D6SS5.44.62.F07.1.454.CMB.2.raw
  modified_base (287)..(287): a, c, t, g, unknown or other
  modified_base (347)..(347): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggctggtatcagcaagaaaccaggaaaactctagaactccngatctatgatgcctcagtttggaaagtggatccatcaacggttcagcggcagtagatcgngggacagtatttcactctcaccatcagcagcctgcagccgtagaacgtattttcgacttaaacgtttacttaacgtgtacctaagtacttaaacgtttttaaactaaccccttttaccccgtctttaccgtaccggttttccggggaacgggtaaacggggttaccctaaaggggttcggaaaagtacgttaacgaaaacggttaacttgggttacggcttacggaccttaaccctaattcccgtttg

SEQ ID NO: 391023 - DNA, 516 bp, Homo sapiens
  misc_feature: GZ8MTXP01EEKKE.44.62.F07.1.454.CMB.2.raw
  modified_base (335)..(335): a, c, t, g, unknown or other
  modified_base (349)..(349): a, c, t, g, unknown or other
  modified_base (447)..(447): a, c, t, g, unknown or other
  modified_base (467)..(467): a, c, t, g, unknown or other
  modified_base (511)..(511): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggggacagagtcaccatcacttgccgggcaagtcagggcataaacagtgctttggcctggtatcagcagaaaccagggaaactcctgaactcctgatctatgatgcctcagttggaaagtggacgtcccatcaaggtcagcggcagtggatctgggacagtattcactctcaccatcagcagcctgcagcctagaagtntttgaactaacttnttactgtacagtactagtttaactaccttaccctctctacgttcggacggaggaaccagggtgagtatacaaacgatgacggggctgaccacatcgtntcttcactccttcccgcctntcctgatattatacttgcgttgacggtcgggctggacaggcgcngtaag

SEQ ID NO: 391024 - DNA, 617 bp, Homo sapiens
  misc_feature: GZ8MTXP01BVU55.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggctttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccgggctccgaggggaggggacgtggagtggggtcttaagtatcggagctgggtggtgtcactttcgtaccggagactcccgtggaaggggcccgcttccaccctatttcccgaggggacctaagttcgacaggactaaattcgtttactacctaaatacgaaaacctgaacgacccgagacacgagcgggtactattactgtttgaaagtccaggaccacggtcgacccccatgaacctactttagtaccgttggggccggggtacgaggttggttcgaaccgtctccttcacgcctccgaaccgaaccggg

SEQ ID NO: 391025 - DNA, 611 bp, Homo sapiens
  misc_feature: GZ8MTXP01DX3SX.44.62.F07.1.454.CMB.2.raw
  modified_base (225)..(225): a, c, t, g, unknown or other
tcagacagtatatacacgaccggtgctcgatttagtagtcgcataaaggggaaagggggagtcagacccactcaggacacagcatggacatgagggtccccgctcagctcctggggcttctgctgctctggctcccaggtgccagatgtgccatccacttgacccagtctccatcctccctgtctgcatcgtggtaggggacagagtcaccatcacttggccggnaagtcagggcaataaacagtgctttggcctggtatcagacaagaaaccgaagggaaacctcctagaactcctgatctatgatcgccttacgtaggtttaggaaagtggacgtcccatacgaaggtcaggcgcaggtaggatcggagggaacagtactttacactctacacctatccagcacgccctagacacggtactagtaaagttatttacgaacttaaacgtttatttaactcgttaacacgttacttaaacgtttaacttaacccttacccttctacgtaaccgtttcggggaacgggtaacgggaccgtaaaggggttggaaacgtaacgttaaacgaaacggttacgttgggtacggctcgaccaccttaagttccgttg

SEQ ID NO: 391026 - DNA, 784 bp, Homo sapiens
  misc_feature: GZ8MTXP01AWZYH.44.62.F07.1.454.CMB.2.raw
  modified_base (339)..(339): a, c, t, g, unknown or other
  modified_base (387)..(387): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgtggagtcgtgggggggcctgattcggcctgggaggtccctgaccctctcctgtgcggctgtgatcaccttagtgctatgcatgactggtccgcggctccgagggagggctggagtgggtctcgagtatcggganctggtgtgtcgtactttccgtacggagactccggtgaaacggggcccncttccacctaactttcccgaggggtaaccaaagttccgactaagggacctaaaagtttcgtttaccttacccgtaaaatacggttaaaaaaaaccccgtacggaaaccgaaccccgtaaacggaaccgtaaccggtaacgggggttaccgttaaccgtttaacgtttaaccggtttacggtttaaacgaaaaccggtacccggaaaccgggtaaccccgtaacccgggtaccccgtaaaccccccgtaagtaaccgtaaacccgttaacccggtttaaaccgggttacccggggttaccggggggtacccgggggttaacggttcggggttaccgggtaaccgggtacccggtttcccttcggttaccgaccgtccccgttaaccccgtaaccccgg

SEQ ID NO: 391027 - DNA, 594 bp, Homo sapiens
  misc_feature: GZ8MTXP01CED4C.44.62.F07.1.454.CMB.2.raw
  modified_base (396)..(396): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccgggctccgagggaggggactggagtgggtctcgaagtatcgggagcgtggtgtgtctactttccacggagactccgtgaaacgggccnctcacctatttccgagggtacaattcgcaggactaaattgttactacaaatacgaaaactgacgaccgagacacgacggggcgtctattactgtttagaacgtcgacggacctacggtcgacccccatcgacttaccttacgttacgtcggggcggggacgcggttggtggaccgtctctcacgtccttccaacccgg

SEQ ID NO: 391028 - DNA, 769 bp, Homo sapiens
  misc_feature: GZ8MTXP01BOU1C.44.62.F07.1.454.CMB.2.raw
tcagacagtatatacacgaccggtgctcgatttagtagtcgcataaagggaaagggagctctgagagaggagcccagccctgggattttcaggtgtcttcatttggtgaccaggaccgaacagagagaagtctccatggagtttgggctgagctgccttttcttgtggtctttttaaaggtgtcgtgtgtgaagtgcagttgttggagtcgtggggggcctgattcggcctgggagtccctcgcctctcctgtcgccgtcctcgtgtcttcctacgttagtcgtcctagtcgctagtcgtaccgtcgggtcccggccggtccgtaccggaggggacgggtacgtgggtagggttcggtacgtaacgtaaggttacggtacgggagtcggttgggttggtcgtcgttaccgtttaccggtacgggtaacgtacccgtccggtaacggaaaccgggtcccgtccgttaccaaccgttaccgtttacccgaacgggtaactaaacgttcccgagtaacggtaaacttaaagtttcgttaaccctaaacctaaaagtaaaccgtaaaacgtcgaaccgaacccgagaacacggacggggtctacttaacgttacgttagttaacgaacgtaccgaaaccggaccgtaccgggtaccccaccccgtagtaaccgaacctttaccgttaacggttacggggttaccgggggaccggttaacgttgggttacgtaacgtccgttcttccgtcgaccgtcccttaaccgaaacccgg

SEQ ID NO: 391029 - DNA, 560 bp, Homo sapiens
  misc_feature: GZ8MTXP01D1HI9.44.62.F07.1.454.CMB.2.raw
  modified_base (553)..(553): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtagggacagagtcacatcacttgccggcaagtcgagggcaataaacagtgctttggcctggtatcagacaagaaaccgaagggaaaactcctagaacctcctagatctatgatcgcctcgtagtttaggaaagtggacgtcccagtacaaaggttcaggcggacaggtaggatcgtaggggacagtatttccactctacaccatacagcacgctgcagcctagaacgtattttacgaacttaaactttatttactgtaccaagtcttaatttaaacttaccttaccctcttactacgttcgggaacggaacggacgtaagggttggaagtaacttacgaaacgacgtggtagcctgccactnttcgttg

SEQ ID NO: 391030 - DNA, 737 bp, Homo sapiens
  misc_feature: GZ8MTXP01CNG5U.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctgtgatcaccttagtgcctatgcatgacctggtccgccgggctccgaggggagggactgggagtgggtctcgaagtatcgggagcgtggtggtgtcactttcctacggagacctccgtggaaacgggccgtcttcgaccctaagtttccccgaaggggtaacctaaagtttccgaccgtaagggtaaaccctaaagtttagtttacctaacccgtaaaattacgtaaaaaacccgtacgaaccggaaccccgaacggaaccgaaccgtaacggggacggttaccttaaagttaccgttacggtttaagaaacgtaccgaaacggacccgaaccggttaccgaacccccccgtaagtaaccggtaaccttaacccgttttacgttaccggtttacgggggacccgggggttacgttacgggttagggtcgtaccggttcctccgttacgaccggtcccttcccgtaaccccg

SEQ ID NO: 391031 - DNA, 865 bp, Homo sapiens
  misc_feature: GZ8MTXP01BR1NH.44.62.F07.1.454.CMB.2.raw
  modified_base (284)..(284): a, c, t, g, unknown or other
  modified_base (339)..(339): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggcctgattcggccgtgggaggtccctgaccctctcctgtgcggcctctggattcacctttagngcctatggcatgacctgggtccgccggctccgagggaggggactggagtgggtcncgaagtgtcggagcgtggtggtgtctacgtttccgtacgggacgacgtccggtaggaaacgggcccgtcttccgaaccctacgtttccccgaaggggtaacctaaagttcccgacgtaacgggtaaacctaaaagtttacggtttacccttaacccgtaaaaaacgttaaccggtaaaaaaaaaccccgttaggaaacccggtaaacccccgggaaacgggaaacccgaaaccggtaacggggggtacccggtttaacccgtttaaactttaaacccggtttaggttttaaacgggaaaaccgtaccccgtaaaaccggggtaaacccgtaaccccggggttaccccgaaaccccccccccgtaagtaacccggtaaacccgttaacccggttttaaacgggttaacccgggtttaccggggggaccccggggggttaacgttacggggttaccgggttaacgggtaaccccgggttccgttcccgttaccgttacccgggtccccttaaccccgtaaaccccggg

SEQ ID NO: 391032 - DNA, 798 bp, Homo sapiens
  misc_feature: GZ8MTXP01DRL9T.44.62.F07.1.454.CMB.2.raw
  modified_base (281)..(281): a, c, t, g, unknown or other
  modified_base (420)..(420): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtccttttcttgtggtctttttaaaggtgtcgtgtgtgaagtgcagttgttggagtcgtggggggggcctgattcggcctgggaggtccctgaccctctcctgtgcgctctggattcacctttagngcctatggcatgacctgggtcccgccgggctccgaggggaggggactggaggtcggggtctacgaaggtagtcgggagcgtgggtggtgtctacgttttccgtacgggagaccgttccggtaggaaaacggggtccccncgtttccaacccctagttttaccccgaaggggaacctaaagttccgacgtaagggtaacttaaaagttcggtttacctaacctaaaaattaacgtaaaaaaccttaggaaccgaaaccccgaaggaacccgaaaccgaacgggggtaccgttaacgttaacgtttaaccgttaggtttaaacgaaacgtacccgaaacggaccccgtaaccgggttacccggaacccccccctaagtaaccgtaacccgttaacccgttttaaacgggttacccgggtttacggggggtacccggggggttaaacgttcgggttacgggtccggtaaccccgggttcctaccggtttccacgggtaaccccttcccgtaaaccccggg

SEQ ID NO: 391033 - DNA, 607 bp, Homo sapiens
  misc_feature: GZ8MTXP01B6DRY.44.62.F07.1.454.CMB.2.raw
  modified_base (284)..(284): a, c, t, g, unknown or other
  modified_base (401)..(401): a, c, t, g, unknown or other
  modified_base (567)..(567): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctctggattcacctttagngcctatggcatgacctgggtcccgccgggctccgaggggagggactggagtgggtctcgaagtatcggagcgtggtgtgtctactttccgacggagacgtccgtggaaacgggcccncttcaccctatttccgaggggacaagttcgcaggacaaattgttactacaaatacgaaaactgaacgaccgaggacacgacgggcgtactatactgttagaaacgccgaacgccgtacgtacgacccccatcgacttaccgttagttacgtcggggccggggacgnggttcggtcgaccgtcgtctcgacgtccgttccgaacccg

SEQ ID NO: 391034 - DNA, 674 bp, Homo sapiens
  misc_feature: GZ8MTXP01AQ8V5.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggagtccctgaccctctcctgtgcggcctctggattcacctttagtgcctatggcatcgaccgtgggtccgccgggctccgaggggaggggactggagtgggtctcgaagtagtcgggagcgtggtggtgtctactttccgacggagtaccgtccggtaggaaacgggcccgcttccacctactttcccgaggggtactaacgttcgacgaaggtaactaaatttcgttactacctaaatacgaaaacctgaacgacccgaagacacgaggggactacgtattacgtgttacgaacgtccgaggaccctaccgggtccaacccccagtcgtaaccgttaccgtttacggttaccgggttcggggggaccggggttacgttgggttcgggtcgtacccggttctccgttccgaccgtcccgttaacccgaaccccggg

SEQ ID NO: 391035 - DNA, 609 bp, Homo sapiens
  misc_feature: GZ8MTXP01DGNC2.44.62.F07.1.454.CMB.2.raw
  modified_base (564)..(564): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggggcctgattcggcctgggaggtccctgaccctctcctgtgcggcctctggattcacctttagtgcctatggcatgacctgggtccgccgggctccgaggggaggggactggagtggggtctcaagtatcgggagcgtggtggtgtctactttccgacggagcgtccgtgaaacgggccctctcacccatttccccgagggacaattcgacaggactaaattgttctacaaatagaaaacctgacgaccgagacacagggcgtactatactgtttagaacgctacgacctacggtacacccccatcgacttacgtttacgttacgttcggggccggggaccgnggttacggtcggaccgttctcttcgacggtcccttccgaacccgg

SEQ ID NO: 391036 - DNA, 538 bp, Homo sapiens
  misc_feature: GZ8MTXP01BWCMV.44.62.F07.1.454.CMB.2.raw
  modified_base (221)..(221): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccggnaagtcagggcaataaacagtgctttggctggtatcagcaagaaaccaggaaactctagaactctgatctatgatcgcctcagtttggaagtgactccatcgaaggtcagcgcagtgatcgtgggacagtactttcactctacacatacagctagcctagcacgcctagtaactatttcgacttaacgtttattacgtgtacagtctaagtttacctacttacctcttacgtacgtttcgggaacggtaggaccgtaagggttgagtaacttacgaaaggactaagggtggctcgacttacgtaacgttccgttaacg

SEQ ID NO: 391037 - DNA, 803 bp, Homo sapiens
  misc_feature: GZ8MTXP01ENZS8.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgcagttgtggagtgtgggggggctgattcggctgggagtcctgaccctctcctgtgcggcctctggattcacctttagtgcctatggcatcgaccgtgggtcccggcccgggctccggaggggaggggacgtgggaggtgggtcacgaaggtagtcggagtcgttgggtggtgtctacgtttccgacgggagtacctccggtaggaaacggggtccctcgttaccaaacccttacgtttacccgaaggggtaactaaacgtttaccggacgtaaagggtaaaccttaaaagtttcggttttaacctaaacccgtaaaaaagttaaccgaaaaaaaaccgttcggaaaccggaaaccccgaagggaaccaaaccgacgggggtaaccgtttacgtttaaactttaccgttaggtttaacgaaaaccggtcccgtaaacgggtaaacccgtaccggggtaacccaacccccccgtaagtaaccgtaacccgtttacccgtttaaacgggttaccgggtttaccggggggaccgggggttaccgttagggttcgggtaacggtacccggttccttccgtcgacccgtcccgttaacccgaaccccgg

SEQ ID NO: 391038 - DNA, 518 bp, Homo sapiens
  misc_feature: GZ8MTXP01AXDO9.44.62.F07.1.454.CMB.2.raw
  modified_base (220)..(220): a, c, t, g, unknown or other
  modified_base (283)..(283): a, c, t, g, unknown or other
  modified_base (367)..(367): a, c, t, g, unknown or other
  modified_base (376)..(376): a, c, t, g, unknown or other
  modified_base (386)..(386): a, c, t, g, unknown or other
  modified_base (436)..(436): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcacatcacttgccggnaagtcagggcataaacagtgctttggcctggtatcagcaagaaaccaggaaactcagactccngatctatgatcgcctctagtttaggaagtgacgtccatcaggtcagcgcagtgatcgtgggacagtcttcactctacacatcancagctgcanctagaacgtntttcgacttaacgttatacgtgtactagtactatttaactccttaccctnttacctcgtttcggaacgggtacgaccgtaaaggttgaatacttacgaaacgacgtggtcgaactggaccaccttgttcgtc

SEQ ID NO: 391039 - DNA, 726 bp, Homo sapiens
  misc_feature: GZ8MTXP01CO3B1.44.62.F07.1.454.CMB.2.raw
tcagacagtatatacacgaccggtgctcgatttagtagtcgcataaaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgctagttgttggagtcggtgggggggcctgagttcggccgtgggacggtccctgaccctctcctgtcgcggtcctctggtattcctacctttagtcgcctatggcagtcgaccgtgggtcccgccgggcctccgaggggacgggtacgtggagtgggtctacgaagtgtcgggagcgtggtgtgtctacgtttcccgacgggacgtcgtccgtaggaaacgggtcccgtcttccacccgtatttccgaacgggtactaagttcgactacggtaactaaagtttcgttacctaactaaaagtaacgaaaaacctgaacgtacccgaagacaacgacggggtcgtacttacgttacgttagtttacgaacgtaccgacgaccgtaaccgggtaccaacccccgtagtccgtaaccgttaccgtttaacggaccgggtttcggggggccgggggttaacccgttgggttaccggggtcgtacccggttcgttcccgttccgaccgtccccgttaacccgtaaccccggg

SEQ ID NO: 391040 - DNA, 712 bp, Homo sapiens
  misc_feature: GZ8MTXP01CP48T.44.62.F07.1.454.CMB.2.raw
  modified_base (239)..(239): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctggtagggacagagtcaccatcacttgccgggcaagtcagggcataaacngtgtcttggcctggtatcagacaagaaaccgaggaaaactcctagaactcctagatactatgaactcgtcccttaccgtaagggttttaggaaacggttcggtacgttaccctaagttaccgtaacgggttaccgaggccggtacgtaggtacgggtaatcggtaggggaactaggttactttccaccttacctaccaacctataccacggcctacggcccttacggaccgtaacgtcccttaaggtaaacgtttgtttttaacgaacctttaaacgttttaacgtttaaccttgttaccgtaaggttaacctttaacgttttaaaccttacccctttaccccttcgttacccgttaccggtttccggggaaccgggtaaacggggaaaccgttaaggggacgtaaacggtacttaaaccggaaacgttacgttcgggaggtccgtacggtaccaccgttaacttccgtttcg

SEQ ID NO: 391041 - DNA, 669 bp, Homo sapiens
  misc_feature: GZ8MTXP01EIPBD.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcggtggggggcctgattcggctgggagtccctgaccctctcctgtgcgcctctggattcactttagtcgcctatggcatcgaccgtcgggtccgccggctccgaggggagggcgtggagtggtctacgagtagtcggagtcgtggtggtgtctactttccgacggagcgtcgtggaaacgggcctcttcaccgtactttccgagggtactaagttcgacacggtaactaaagtttcgtttacctaactaaaataacgtaaaaacctgaacgaacccgaaggaaccaacgaggggtaccttacgttaactttacgttagtttacgaaacgccgaacggaccctacggtacccacccccagtccgaacttaccgtttacggttaccggtacgggggaccggggacgttggttcgggtcgtaccgtcttccgttccgacgtccccgttccgaacccgg

SEQ ID NO: 391042 - DNA, 565 bp, Homo sapiens
  misc_feature: GZ8MTXP01BTN59.44.62.F07.1.454.CMB.2.raw
  modified_base (221)..(221): a, c, t, g, unknown or other
  modified_base (344)..(344): a, c, t, g, unknown or other
  modified_base (414)..(414): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtagggacagagtcaccatcacttgccgggnaagtcagggcataacagtgcttggctggtatcagcagaaaccgaggaaaactctagaactcctgatctatgatgcctcgtaggtttaggaaaggtggacgtccatcgtaacggttcaggcggnaggtggatcgtaggggactagtatttccactctacaccatcagcagccctagcacgtccgtagaaagttnttttagaccttaactttacgttacgtgtacagtctaagtttaactaccttacctctacttcgttcgggaacggtacgggacctagggttaggaacgtaacttaccgaaacggttacgttcggtagtccgtcgacttacctaattccgttcg

SEQ ID NO: 391043 - DNA, 655 bp, Homo sapiens
  misc_feature: GZ8MTXP01DGH30.44.62.F07.1.454.CMB.2.raw
  modified_base (163)..(163): a, c, t, g, unknown or other
  modified_base (171)..(171): a, c, t, g, unknown or other
  modified_base (198)..(198): a, c, t, g, unknown or other
  modified_base (272)..(272): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctcatggagtttgggctgagctgtccttttnttgtggtntttttaaagggtgtgtgtgtgaagtgnagttgtggagtcgtggggggctgattcggcctgggagtcctgacctctcctgtgcggctctggattcacttagngcctatggcatgacctggtccgcggctccgagggagggactggagtggtctcaagtatcggagcgtggtgtgtcactttccgaacggagactccgtgaaacggggcctcttacacactttccgaagggacaaattcgacaaggacctaaaagtttcgttactaactaaaataacgaaaactagaacgaaccgaagaactaacgacggggtacgttaacttaacttacgttagttaacgaaacgtaccgaaacggaaccgtaaccggtacccgaaccccaagtaacgtaaccgttacgtttaacggttacgggttacggggaccgggttacgttcggttcggtaacgtaccgttctacgtacgaccgtcccgttaaccgaaccg

SEQ ID NO: 391044 - DNA, 712 bp, Homo sapiens
  misc_feature: GZ8MTXP01CJARS.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgctagttgtggagtcggtgggggggcctgagttcggcctgggacgtccctgaccctctcctgtcgcgcctctggtattcacctttagcgcctatggcatcggaccgtgggtcccgccggcctccggaggggagggacgtggaggtcgggtctacgagtagtcggagcgtggtggtacgtctactttccgacggtacgacgtcggtagaaacggggtccctctccaccgtactttccgaagggtactaacgttcgacgtaaggtaactaaacgtttcgttacctaacgtaaagtaaacgtaaaaccgtggaacgaaccccgaggaccgacgtacggggtacgtacgttaattacgttagtttaacgaaacgtaccgaacggaccctaccggtacccgaccccctagtaaccgtaccgttacgtttacggttacgggttacgggggtccgggttaacgttcggttcgggtcgtacccgttccgtccgttcgaccgtcccgttaacccgaacccgg

SEQ ID NO: 391045 - DNA, 636 bp, Homo sapiens
  misc_feature: GZ8MTXP01BF16D.44.62.F07.1.454.CMB.2.raw
  modified_base (260)..(260): a, c, t, g, unknown or other
  modified_base (268)..(268): a, c, t, g, unknown or other
  modified_base (273)..(273): a, c, t, g, unknown or other
  modified_base (333)..(333): a, c, t, g, unknown or other
tcagacagtatatacacgaccggtgctcgatttagtagtcgcataaaagggaaaggggagctctgagagaggagcccagccctgggattttcaggtgtcttcatttggtgaccaggaccgaacagagagaagtctccatggagtttgggctgagctgtcctttttcttgtggtctttttaaaggtgtcgtgtgtgaagtgctagttgtggagtcgtgggggggcctgattcggcctgggacgtccctgaccctctcctgngcggctgngatcncttagtgctatgcatgactggtccgcggctcgagggagggctggagtgggtcacgaagtntccggagcgtggtggtgtctacttccgtacggtacgacgtccgtacgaaacggccgctcaccacttcgacggtactactacgacaggactaattacgttactacctaaactaacgtaaactacgacgaccgacgaacgacgacgggtacgtacttattacgttagttagtaacgacgacggaccgtaccggtaccgtaccccgtacgaacacgttaccgttacgttaacggttcggggtcgggaccggttcggttggttaacgggccgtcgtcgttcccgttaccgtcccgttcccgtaaccg

SEQ ID NO: 391046 - DNA, 822 bp, Homo sapiens
  misc_feature: GZ8MTXP01B6WWF.44.62.F07.1.454.CMB.2.raw
  modified_base (340)..(340): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgtggagtcgtgggggggcctgattcggcctgggaggtccctgaccctctcctgtgcggcctctggattcactttagtgcctatggcatgacctgggtccgccggctccgagggagggctggagtgggtctcgaagtntcgggagcgtggtggtgtctacgtttccgacggtagactccggtggaaacggggccctcgttcaccgtacttttcccgaaggggtaacctaaagtttccgaccgtaagggtaaacctaaaacgtttcggttttaccgttaccctaaaaacgttaacggtaaaaaaacccgttacggaaaccggtaaaccccggaagggaaacccgaaccggaacgggggtaccggttaccgtttaacgtttaacccgtttaggttttaacggaaaacggttcccgaaacgggaaccccgtaacccgggggtacccgtaaccccccccgtagttaaccggtaaacccgttaacccggttttaaaccggttaccgggttttaccggggggccccggggggttaaaccggttacggggttacggggtccgggtaaccccggtttccgttcccgttaccgttaaccggtccccgttaaccccgtaaacccccgggg

SEQ ID NO: 391047 - DNA, 781 bp, Homo sapiens
  misc_feature: GZ8MTXP01EQ3MT.44.62.F07.1.454.CMB.2.raw
  modified_base (267)..(267): a, c, t, g, unknown or other
  modified_base (282)..(282): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtgggggggcctgattcggctgggagtccctgaccctctcctgtgcggcctntggattcactttagngcctatggcatcgaccgtgggtcccgccgggctccgaggggagggacgtggaggtgggtctacgaagtgtcgggagcgtggtggtgtctactttccgacggagacgtccgtaggaaacgggccgtcttcacctatttccgagggtacaacgttcgacgtaggaactaaagtttcgtttacctaacgtaaaactaacgtaaaaacctcggaacgaacccggaaggaaccacgaacgggggtaccgtttacgttaaacgtttaccgttaggtttaaacgaaacggtacccgaaaccgggtacccgtaaccgggttaccccgaaacccccccgtaagtaaccggtaaacccgttaacccgttttaacgggttaaccgggtttaccgggggggtaacccggggggttaaccgttacgggggtttacggggtaaccgggttaaccccggtttccgttacccgtttaccggaaccgtccccgttaaccccggtaaaaccccgggg

SEQ ID NO: 391048 - DNA, 751 bp, Homo sapiens
  misc_feature: GZ8MTXP01CYJC2.44.62.F07.1.454.CMB.2.raw
  modified_base (271)..(271): a, c, t, g, unknown or other
  modified_base (286)..(286): a, c, t, g, unknown or other
  modified_base (402)..(402): a, c, t, g, unknown or other
tcagacagtatatacacgaccggtgctcgatttagtagtcgcataaaagggaaaggggagctctgagagaggagcccagccctgggattttcaggtgtcttcatttggtgaccaggaccgaacagagagaagtctccatggagtttgggctgagctgtcctttttcttgtggtcttttttaaaggtgtcgtgtgtgaagtgctagttgttggagtcggtggggggcctggagttcggcgtgggacgtccctgaccctctctgtcgcgcctntgattctacttagtnctatgcatcgacgtcggtccgccggctcgaggggagggcgtggtaggtggtctacgaagtagtcggagcgtggtgtgtctacgtttccgtacggagcgtcgaggaacggcctctcncctaaaaaacgttccgaaagggtactaaacgttcgacgaacggtaaactaaagtttcgtttacctaaaccgtaaaacgttaaacgtaaaaacctacggaaaccggaaacccgaacggaaaccgaaccggaacgggggtaccggtttaactttaacgtttaaccgttagtttaaacggaaacgtaccggaaaccggtaaccgtaaccggtacccgaacccccgtaagtaaccgtaaccttaccgtttaacggttaccgggttacgggggtccggggttaacgttcgggttacggtaaccgtaccgttccgttcgttaccgttaccgtaaccccgttaaccgaaaccccgg

SEQ ID NO: 391049 - DNA, 545 bp, Homo sapiens
  misc_feature: GZ8MTXP01EXKH3.44.62.F07.1.454.CMB.2.raw
  modified_base (224)..(224): a, c, t, g, unknown or other
  modified_base (243)..(243): a, c, t, g, unknown or other
  modified_base (349)..(349): a, c, t, g, unknown or other
  modified_base (424)..(424): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgaccccagtcctccatcctccctgtctgcatctggtaggggacagagtcaccatcacttgccggnaagtcgagggcaataaacngtgctttggcctggtatcagacaagaaaccagggaaaactctagaactctgatctatgatcgcctcgtaggtttaggaagtgacgtcccatcgaaggtcagcgganagtggatcgtagggactagtacttcactcacacatcagcacgcctagcacgctagattcttagacttaacgtttnttactgtacagtctaagtttactaccttcctctactcgttcgggcggtaagggacctagggttagactaacgttaacgaacgttacgttggtacgctggaccttacctaagtttcgtaacg

SEQ ID NO: 391050 - DNA, 744 bp, Homo sapiens
  misc_feature: GZ8MTXP01A1DBZ.44.62.F07.1.454.CMB.2.raw
tcagacagtatatacacgaccggtgctcgatttagtagtcgcataaagggaaaggggagctctgagagaggagcccagccctgggatttttcaggtgtcttcatttggtgaccaggaccgaacagagagaagtctccatggagtttgggctgagctgtcctttttcttgtggtcttttttaaagggtgtcgtgtgtgaagtgcagttgttggagtcgtgggggggcctgagttcggccgtgggacggtccctgaccctctcctgtcgcggcctctggtattcacctttagtcgcctatggcatcgaccgtcggtccgccggctccgagggagggctggagtggtctgaagtagtcgggagtcgtggttggtgtctactttccgtacggagtaccgtccggtaggaaacgggcccgtcttaccgtaccctacgtttccccgaaggggtacctaagtttccgacgtaaggtaactaaagtttcgtttacctaccgtaaaagttaacgaaaaacccttggaaccgaccccgaacggaccaaccgacggggtaccgttacttaacgtttacgttaggtttaagaaacgtacccgtaacggacccgtaaccgggtacccgaaccccccgagtaaccgtaacccttaccgtttacggttaccggttaccgggggacccggggttacgttacgggttcggttcggtacccgttccgttccgttccgaccgtccccgttcccgaaccccggg

SEQ ID NO: 391051 - DNA, 652 bp, Homo sapiens
  misc_feature: GZ8MTXP01E3ID7.44.62.F07.1.454.CMB.2.raw
  modified_base (404)..(404): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggctttttaaaggtgtcgtgtgtgaagtgcagttgttggagtcgtggggggcctgattcggcctgggaggtccctgaccctcctcctgtgcggcctctgattcactttagtcgtcctatggcatcgaccgtgggtccggccggctccgagggagggacgtggaggtgggtctcgaagtagtcgggagcgtggtggtgtcgtactttccgtacggagacgtccgtagaaacgggcccncgttcaacctactttccgaaggggaacagttccgacacggaactaaattcgttactacaaagtaacgtaaaaccagaacgaccgacggaacacgagggcgtacttattacgtagtttagaacgtaccgaacgacccgtacggtaccgacccccagtcgtaaccttaccgtttacgttaccggttcgggggaccggggacgaggttcggtcgtacccgtcttccgtccgacgtcccgttccgaacccgg

SEQ ID NO: 391052 - DNA, 639 bp, Homo sapiens
  misc_feature: GZ8MTXP01AILPB.44.62.F07.1.454.CMB.2.raw
  modified_base (283)..(283): a, c, t, g, unknown or other
  modified_base (489)..(489): a, c, t, g, unknown or other
  modified_base (537)..(537): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctctggattcactttagngcctatggcatgaccgtgggtcccgccgggctccgagggggggactgggagtggggtctcgaagtagtcgggagcgtgggtggtgtcacgtttctaccggagactccggtgaagggcccgcttccacctagtttccaggggactaagttccgacaggactaaaatttcggttactaccaaatagaaaacctgacgaccgagacacnggcgtctattctgttagaacgcacggacctacgggtccacccccaagngaaccctactttaggtaccggttgggggcccgggggaacaggttcgggttacgtaacccggtctccgttcgacggttccctaacccgaaccggtaacccggg

SEQ ID NO: 391053 - DNA, 683 bp, Homo sapiens
  misc_feature: GZ8MTXP01EYQAD.44.62.F07.1.454.CMB.2.raw
  modified_base (266)..(266): a, c, t, g, unknown or other
  modified_base (279)..(279): a, c, t, g, unknown or other
  modified_base (284)..(284): a, c, t, g, unknown or other
tcagacagtatatacacgaccggtgctcgatttagtagtcgcataaagggaaaggggagctctgagagaggagcccagccctgggatttttcaggtgtcttcatttggtgaccaggaccgaacagagagaagtctccatggagtttgggctgagctgtcctttttcttgtggtctttttaaaggtgtcgtgtgtgaagtgcagttgttggagtcggtggggggcctgattcggccgtgggacgtccctgaccctctctgtgcgctntgattcacttagngctangcatgaccgtgggtccgccggctaccggaggggagggacgtggaggtggtcgtacgaacgtgcgggtagcgttgggtgtgttcgtacttttccgaacggagtaccgtccggtacggaaacgggtcccgtcttaccgaacctacgtttacccgaacggggtactaaagttcccgacgtaaggtaacctaaagtttcgttacctaactaaaacgtacgtaaaaccgtgaacgacccgaagacacgagggtcgttactattacgtagttacgaacgtccgaacggaccgtaccggtacccacccccataaccgtaaccttacgttacggttacggtcgggggaccgggacgttggttcggtcgtaccgttcgtcgttcgaccgtccgttaacccgaacccgg

SEQ ID NO: 391054 - DNA, 734 bp, Homo sapiens
  misc_feature: GZ8MTXP01DF8H5.44.62.F07.1.454.CMB.2.raw
  modified_base (255)..(255): a, c, t, g, unknown or other
  modified_base (390)..(390): a, c, t, g, unknown or other
tcagacagtatatacacgaccggtgctcgatttagtagtcgcataaagggaaagggggagtcagaccccactcaggacacagcatggacatgagggtccccgctcagctcctggggcttctgctgctctggctcccaggtgccagatgtgccatccacttgacccagtctccatcctccctgtctgcattcgtggtagggacagacgtccaccatcctacgttggaccgggacaagtcgaaggggacaataaacnggtgtcgtttcggcctggtactcgagacgaacgtaaaccgaaaggtaaacctcgtacgaactcctagacttctagtgtatcgccgttacgtaggtttaggaaagtggtacctccagtacgtaacggtcgaggcgngaggtagactggtacggatacgtactttaccacttactaccgacagtacacggaccacggtacgtacgacgtacgtcgttaagtaaagtttacgtttacaaaccttttaactttacgttttaccgtaacgttacgtaaggttaacctttaaacgtttttaaccttaaacccggttttcccttaccgttacgggttcccggtttaaacgggggaaccggggttaaacggttaacccgggtaaaggggttaacgtaacgggttaacttaaaccggaaaacggtttaccggtgggttaaccggtccttaacggacccttaaccggtttctttcccgggttttaaccc

SEQ ID NO: 391055 - DNA, 718 bp, Homo sapiens
  misc_feature: GZ8MTXP01ACHJD.44.62.F07.1.454.CMB.2.raw
  modified_base (268)..(268): a, c, t, g, unknown or other
  modified_base (290)..(290): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcggtggggggcctgattcggccgtgggagtccctgaccctctcctgtgcggcctntggattcaccttagtcgcctanggcatcgaccgtggccgccggctccgaggggagggctggaggtggtctacgaagtgtcgggagtcgtggtgtcgtctacgtttccgacggacgacgtccggagaaacgggcctcgtcaccgtattcccgagggtactacgttcgactaggaacctaaagttcgttacctaacctaaagtacgaaaacctgaaccgaacccgaaggtaaccacgacgggggtacgttacgttaacgtttaccgttaggtttacgaaacgtacccgaaacggtaccccgtacggtacccgaacccccgagtaaccgtaaccgttaacccggtttacgttaccgggttccggggggaacccggggttacgttacgggttacgggtaaccggtacccgttccgttaccgttcccgaccgtccccgttaacccgaaccccggg

SEQ ID NO: 391056 - DNA, 717 bp, Homo sapiens
  misc_feature: GZ8MTXP01A5EH0.44.62.F07.1.454.CMB.2.raw
  modified_base (272)..(272): a, c, t, g, unknown or other
  modified_base (445)..(445): a, c, t, g, unknown or other
tcagacagtatatacacgaccggtgctcgatttagtagtcgcataaagggaaaggggagctctgagagaggagcccagccctgggatttttcaggtgtcttcatttggtgaccaggaccgaacagagagaagtctccatggagtttgggctgagctgtcctttttcttgtggtcttttttaaggtgtcgtgtgtgaagtgctagttgttggagtcggtgggggggcctggattcggccgtgggacgtccctcgaccctctctgtcgcgcctntgattcacttagtcgcctagtgcatcgaccgtgggtcccgccggctccgaggggagggacgtggaggtggtctacgagtagtacggagcgttggtggtgtctctttccgtacggagtccgtcggtgaaacgggtccgtccttcgactactttccgagggtaactacgtccganacggtaactaaagtttcttaccgttacaaaacgttacgaaaaccgtagaaccgaccgaacggacaacggagggtaccgttacttacgttaacctgtttaacggaacgtaccgaaccggtaccgtaacccggtaccgtaccccccgagtaaccgtaacccgttacccggtttaacgttacgggttacgggggtacccggggttaacgttcgggttacgggttaaccggtaccggttccttccgtccgttaccgtcccgttcccgaaccccggg

SEQ ID NO: 391057 - DNA, 711 bp, Homo sapiens
  misc_feature: GZ8MTXP01DJI3S.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgatcggcctgggagtccctgaccctctcctgtcgcggcctctggattcacctttagtgcctatggcatgaccgtgggtccgccgggctccgagggaggggacgtggaggtgggtctacgaagtagtcggagcgtggtggtgtctactttccgacggagaccgtccgtggaaacgggcccgcttccaaccctatttcccgaggggactaaacgttcgacgaaggactaaagtttgtttacctaaccaaaatacgaaaaacctgaacgaacccgaaggaccaacgaggggtcgtactaactttaccgtagtttaacgaaacgaccgtaacggacccgtaccggtaccgaacccccctagtaaccgaacttacccgtttaacggttacggttaccgggggtccgggggacgttcgggttacggggtccggtaacccggttccgttcccgttaccgttaccggtccccgttccccgtaaaacccccggg

SEQ ID NO: 391058 - DNA, 844 bp, Homo sapiens
  misc_feature: GZ8MTXP01D6IRQ.44.62.F07.1.454.CMB.2.raw
  modified_base (267)..(267): a, c, t, g, unknown or other
  modified_base (283)..(283): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtctttttaaagggtgtcgtgtgtgaagtgcagttgttggagtcgtggggggcctgattcggcctgggagtccctcgcctctctgcgcgtcctgtgtntctacttgcgtctagngctgtcgacggtcggtcccggccggctcggaggggacggcgtggaggtcggtctacgtaaggtacgtagggacgtcggttgggttggtcgtacctaccgttttacccggaacggtacgtaccgttccggtacgggtaaacccgggccgttcctacccgtaacccgttacgtttacccgggaacgggtaaccttacgttaccgacgtaacggtaaactttaaacgttttccggtttaccctaaaaccgttaaaaacgttaaaccgaaaaacccgttacggaaacccggtaaaccccggtaaagggaaacccaaccgggtaacgggggttaccggttaacctttaaacgttttaaccgtttacgggtttaaacgtaaaccggtaccggaaacccggtaacccgtaaacccggggttaccccaacccccccgtaagtaacccgtaacccgttaacccgtttaacgggttaccggggtaaccggggggtccggggttaaccgttgggttacggggtaacgtacccgtttcggtccttacgcccggtaacccttcccggaacccgg

SEQ ID NO: 391059 - DNA, 762 bp, Homo sapiens
  misc_feature: GZ8MTXP01B9DTR.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaaggtgtcgtgtgtgaagtgctagttgttggagtcgtgggggggcctgattcggcctgggagtccctcgacccctctcctgtcgcggtcctcgtggtacttctaccgtttagtcgtcctatggccagtcggacccgtggggtcccggcccgggccgtaccggaggggacggggacgtggaggtgggtcctacgaagtagtccggagtcgtggtggttcgtacttacgtttacccgtacggagtaccgtccggtacggaaacggggtccccgtcgtttcccgaaacccgtacgttttacccgaaggggtacctaaacgttcggacgtaacgggtaaactaaagtttccggtttacctacccgtaaaaagttaccgaaaaaacctcggaaccgaacccgaggaaccacgacggggtacgttaccttagttaactggtttaacgaaacgtaccgtacggaacccgtaccggtacccgaccccctagtccgtaaccttaccgtttaacgggttcgttacggggggccgggttacgttggttcggtcgtaccggtccttcgttccgacgtcccgttccgtaaacccgg

SEQ ID NO: 391060 - DNA, 824 bp, Homo sapiens
  misc_feature: GZ8MTXP01ECBK3.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtggggggcctgagtcggcctgggacgtcctgaccctctcctgtgcggcctcgtgattcacttagtcgcctatgcatgaccgtcggtccgccggctccgaggggagggacgtggagtggtctagtagtagtcggagtcgtgggtagtgtctacgtttcgacggagtaccgtccggtaggaaaccgggccctccgttcaaacccgttactttaccccggaacggggtaacctaaacgtttacccggacgtaacgggtaaaccttaaacgtttacggttttaaccctaaaccgttaaaaacgttaaaccggtaaaaaaacccgttcggaaacccggaaaccccgggaaacggaaccgaaaccgtacggggggtaccgtttacgtttaaactttaaccgttaggtttaaacgaaaccggtacccgtaaacggtacccgtaaccgggttacccgaacccccccgaagttaaccgtaaacccttacccggttttaacgttaaccgggtttcccggggggaaccggggttaccggttacggggttacggtaaccggggtacccttcggtttaccccttacggaaccccgtccccgttaaccccgtaaaccccggg

SEQ ID NO: 391061 - DNA, 670 bp, Homo sapiens
  misc_feature: GZ8MTXP01AN70O.44.62.F07.1.454.CMB.2.raw
  modified_base (565)..(565): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtgggggggcctgattcggccgtgggacggtccctcgaccctctcctgtgcgcctctggtattctacctttagtcgcctatggcatcgaccgtgggtcccgcccgggctccggaggggacggggacgtgggaggtcgggtctacgaagtagtcggagtcgtgggtggtgtctactttccgacggagctcggtgaaacgggcccgtcttcacctactttccgagggacattcgacagaactaatttcgttactaacctaaatacgaaaaccgtcgaacgacccgagacacgacggggctaccctattacgttgttagaacgtaccgacgaccgtaccggtaccacccctanaacgaccttaccgtttacggttacggttacgggggccgggttacgttacgggttcggtccggtaccgttcgtacccttcggacctcccgttaacccgaacccggg

SEQ ID NO: 391062 - DNA, 774 bp, Homo sapiens
  misc_feature: GZ8MTXP01ALNH2.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgcagttgtggagtcggtgggggggcctgagttcggccgtgggacgtccctgtaccctctccgtgtcgcgtcctctggacttcaccttagtcgcctagtggctatcgaccgtcgggtcccggccgggctccggaaggggacggggacgtgggtaggtcgggtctacgaaggtagtcgggagtcggtgggttaggttcgtccgtacgttttaccccgaacgggtacgtacccgtccggtagggaaaaccggggtccctcttacccaacccgttacgtttacccggacggggtaactaaacgttccggacgtaacggtaaccttaaaagtttcgtttacctaaactaaaacgtaacgtaaaaacccgtacggaaccgaaccccgaaggaacctaacggacgggggttactacgttaacgttaccgttaggttaacgaaaccgaccggaaccggtaacccgaccggggtaccctaccccccgaagtccgtaacccgttacgtttacggttacgggttacgggggaccgggacgttgggttacggtcgtacgtcctcgtacgcctccgttcgaaccccgg

SEQ ID NO: 391063 - DNA, 535 bp, Homo sapiens
  misc_feature: GZ8MTXP02GTSGD.44.62.F07.1.454.CMB.2.raw
  modified_base (397)..(397): a, c, t, g, unknown or other
  modified_base (415)..(415): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggcctggtatcagcagaaaccaggaaactctagaactcctgatctatgatgcctcagtttaggaaagtggacgtccatcgaagttcagcggcagtggatcgtgggactagatttcactctacaccatcagcagctgacagcctagaacgtnttttagacttaaactttnttaactgtacagtcttaagtttaaactaccttaccctcttctacgtttcgggacggacgggtaccaagggtacggagtactacgaaacgtacgtgtacggctacgaccacctagtcttcg

SEQ ID NO: 391064 - DNA, 505 bp, Homo sapiens
  misc_feature: GZ8MTXP02H5Q3T.44.62.F07.1.454.CMB.2.raw
tcagacagtatatacacgaccggtgctcgatttagtagtcgcataaagggaaaggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggcctggtatcagcagaaaccaggaaactctgaactctgatctatgatgcctcagtttgaagtgagtccatcaagtcagcgcagtggatcgtgggacagtatttcactctcaccatcagcagccctgcagcctagagtattttagactaaacttattactgaccaacagtataagtagttaattctactagtagttttcggaccgtagggggaccaaggcgtaggacgatacgaaaacgtactgtacggctacgcaccta

SEQ ID NO: 391065 - DNA, 501 bp, Homo sapiens
  misc_feature: GZ8MTXP02JT6H8.44.62.F07.1.454.CMB.2.raw
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggcctggtatcagcagaaaccaggaaactcctgaactctgatctatgatgcctcagtttggaagtggagtccatcaaggttcagcgcagtggatcgtgggacagtattcactctcaccatcagcagccctgcagcctagagtatttagactaacttattactgtcatctaagtttactaccttacctctctacgttcggacggtacggacagggtgacgactacgaaacgactggtcgctacgcacctatcttcg

SEQ ID NO: 391066 - DNA, 695 bp, Homo sapiens
  misc_feature: GZ8MTXP02G56IB.44.62.F07.1.454.CMB.2.raw
  modified_base (267)..(267): a, c, t, g, unknown or other
  modified_base (277)..(277): a, c, t, g, unknown or other
  modified_base (282)..(282): a, c, t, g, unknown or other
  modified_base (286)..(286): a, c, t, g, unknown or other
  modified_base (303)..(303): a, c, t, g, unknown or other
  modified_base (335)..(335): a, c, t, g, unknown or other
tcagacagtatatacacgaccggtgctcgatttagtagtcgcataaagggaaaggggagctctgagagaggagcccagccctgggattttcaggtgtcttcatttggtgaccagggaccgaacagagagaagtctccatggagtttgggctgagctgccttttcttgtggtctttttaaagggtgtcgtgtgtgaagtgcagttgttggagtcgtgggggggcctgattcggcctgggaggtccctgaccctctcctgtgcggctgngatcacttangctangcangctggccgcggctccgnggaggctggagtgggtctgaagtagtcggagngtggtggtgtcgtactttccgtacgagtacgtcgtgaacggccggcctctacctactttccgtacggacgtaacgttacgtaccgaacggtaacgtaaacttaggtttaccttaccctaaattaaacggtaaaacctaacgaacgacccgaacggaacgaacgaaacggcggtaccgtacttacgttagtttagtaaacgacgacggaaccgtaaaccggtcccgtaccccgaccgttacgaacctaaccgtttaccggttaaacggtttaccgggggtccgggggtacccggaacggttagggtaacggtaccgggtaccgttaccgttacccgtaccgtacccgtacccgtaacccgg

SEQ ID NO: 391067 - DNA, 532 bp, Homo sapiens
  misc_feature: GZ8MTXP02G0WD6.44.62.F07.1.454.CMB.2.raw
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggcctggtatcagcagaaaccaggaaaacctcctagaactcctgatctatgatgcctcagtttaggaaagtggacgtccatcaaggttcagcggcagtggatcgtgggacagtatttcactctcaccatcagcagcctgcagcctagagtatttagcttaaactttattactcgaccaaacagtaataaggtatttattactacgtagtagttttcgggaccgaggggaccctaaaggccgtaggaagtacgtacgaaaacgtacgtaggtcggactcgacaccta

SEQ ID NO: 391068 - DNA, 627 bp, Homo sapiens
  misc_feature: GZ8MTXP02GYPFM.44.62.F07.1.454.CMB.2.raw
  modified_base (340)..(340): a, c, t, g, unknown or other
  modified_base (382)..(382): a, c, t, g, unknown or other
  modified_base (389)..(389): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggagtccctgaccctctcctgtgcggcctctggattcacctttagtgcctatggcatgacctgggtcccgccgggctccgagggaggggactggagtgggtcncgaagtagtcgggagcgtggtggtgtctactttccgacgganactccgnggaacgggccgcttcacctattccgagggtacaattcgacaggactaaagttctttacgtacccaaatacgaaaacctagaacgacccgagaacacgacggcgttacgtattactagtttacgaaacgtccgacggaccacggtccgacccccgagtcgaactacctttacgtacgttacggggaccggggacgacggttggtcgacccgttcgtactcgacgtccctccgaacccgg

SEQ ID NO: 391069 - DNA, 860 bp, Homo sapiens
  misc_feature: GZ8MTXP02H1M63.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtggggggggcctgattcggccgtgggaggtccctgaccctctcctgtgcggcctctggattctacctttagtcgcctatggcatgacctggggtccgccgggctcccgaggggaggggacgtgggagtggggtctcgaaggtatcgggagcgtgggtggtgtcgtactttccgacgggagtacctccggtagaaacggggcccgtcctttaccaacctacgttttcccgaagggggtaacctaaagtttccgacgtaacgggaaacctaaaagtttcggtttaccctaacccttaaaagttaaaccggaaaaaaaccgttacggaaaccggaaccccggaaacgggaaacccgtaaacggaaacggggtacccggtttaaccttaagtttaaacccgttaggtttttaaacggaaaaaccggtaccccggtaaacgggaaaccccggtaaacccggggttaccccgggaaaccccccccctaaacggttaaccggtaaaaccccgttaacccgttttaaaccggttaaaccgggtttccggggggtaaccccggggggaaaccgtacggggttacggggtaacggaaccccggttacgttcccgtttaccgacccgtaccccgttacccgtaaaacccccgggg

SEQ ID NO: 391070 - DNA, 590 bp, Homo sapiens
  misc_feature: GZ8MTXP02GH421.44.62.F07.1.454.CMB.2.raw
  modified_base (269)..(269): a, c, t, g, unknown or other
  modified_base (561)..(561): a, c, t, g, unknown or other
  modified_base (575)..(575): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtctttttaaagggtgtcgtgtgtgaagtgcagttgttggagtcgtgggggggcctgattcggcctgggaggtccctgaccctctcctgtgcggcctcgngatcaccttagtgcctatgcatgacctgggtccgccgggctccgagggacgggactggagtgggtctcaaggtatcgggagcgtgggtggtgtctactttccgtacgggagtactccgtggaacgggccgcttccacctatttcccgagggacaattcgcaggacaaattgttacaccaaatacgaaaacctgacgacccgagacacgaggcgtactattactgttagaagtcaggaccacggtcacccccatcgactacgttacgtacgttcggggccgggacaggtcggngtaccgtctcttcncgtccctccgaccgg

SEQ ID NO: 391071 - DNA, 785 bp, Homo sapiens
  misc_feature: GZ8MTXP02H2KCK.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtcgtggggggggcctgattcggcctgggaggtccctgaccctctcctgtgcggcctctggattcacctttagtgcctatggcatgacctggtccgccgggctccgagggacgggactggagtgggtctcgaagtatcgggagtcgtgggtggtgtctacgttttccgacgggacgtactccggttaggaaacggggcccgtcgtttaccgaaccctacgtttttcccgaagggggtacctaaacgtttccggaccgtaagggaaaccctaaaagtttcggtttacctaccctaaaagttacgaaaaaaccttggaaacgaacccgaaggaaccaacgaacgggtaccgttacttaaacgtttacgttagtttaacgaaacgtacccgtaacgggaacccgtaaccgggttacccgaaacccccccgtaagttaccgtaacccgttaacccgttttaaacggttaacccggttacggggggtaccccgggggtaacgtaacgggttcggggttaaccggtaacccggtttccgttacccgtttaccgaccggtaccccgttacccgaaaccccggg

SEQ ID NO: 391072 - DNA, 596 bp, Homo sapiens
  misc_feature: GZ8MTXP02I2ZKI.44.62.F07.1.454.CMB.2.raw
  modified_base (399)..(399): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgacctgggtcccgccgggctccgaggggagggactggaggtgggtctcaagtatcgggagcgtggtggtgtcactttccgtacggagactccgtgaacggggccncgttcacctatttccaggggacaattcgcagacaaattgttctacaaatagaaaacctgacgaccgagacacgagcgtactatactgttagaagcaggaccacggtcgacccccagtcgactacctttacgtaacgttcgggggaccggggacaggtcggtcgaccggtctccgttacacggtccctaccaacccgg

SEQ ID NO: 391073 - DNA, 665 bp, Homo sapiens
  misc_feature: GZ8MTXP02GY26Y.44.62.F07.1.454.CMB.2.raw
  modified_base (241)..(241): a, c, t, g, unknown or other
  modified_base (404)..(404): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctggtaggggacagagtcaccatcacttgccgggcaagtcagggcaataaacngtgctttggcctggtatcagcaagaaaccgaggaaaactcctagaactcctgatctatgatcgcctcgtagtttaggaaagttgggacgtcccatacgaaacggttcgagcggctaggtggatcgtaggggacagtacttcactctcaccatcagcagcccgngccagtaccgtagtaacgtttacgttttacgaaaccttaaactttacttaacgtacgtaaaccctaaagttaaacgttaaagttaaggttaacgttttaactttaccgttacggtaaacggtttacgggttttaaccggggaccgggtaaacgggggtaaaccgtaaacgggtacggttaaacggggtaaacgtaaaccgttaaaccggtaaaaccggttaacggttacggggtacggtaccgtacggaccctaaccgtcg

SEQ ID NO: 391074 - DNA, 629 bp, Homo sapiens
  misc_feature: GZ8MTXP02I720B.44.62.F07.1.454.CMB.2.raw
  modified_base (597)..(597): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtcgtgggggggcctgattcggcctgggaggtccctgaccctctcctgtgcggcctctggattcacctttagtgcctatggcatgacctgggtcccgccgggctccgagggaggggactggagtgggtctcgaagtatcgggagcgtgggtggtgtctactttccgtacggagactccggtggaaacggggccctcgttaccaccctatttcccgaggggacctaaatttccgacagggaacctaaaatttcggtttactaccctaaaatacgaaaaaacccttgaacgaccccgaggaaccacgaggcgtactattactagtttagaaacgcctaaggaccacggtcgacccccatcgactaccttacgtacgtcggggccgggacngtaggcgaccgtctcgtcacgcctccaacccg

SEQ ID NO: 391075 - DNA, 693 bp, Homo sapiens
  misc_feature: GZ8MTXP02HMJWZ.44.62.F07.1.454.CMB.2.raw
  modified_base (284)..(284): a, c, t, g, unknown or other
  modified_base (402)..(402): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctctggattcacctttagngcctatggcatgacctgggtccgccgggctccgagggagggactgggagtggggtctcgaagtatcggagcgtggtgtgtctactttccgtacggagacctccggtagaacggggccncgtttcgacctatttcccgaaggggtacaaagttccgacaggaactaaagttgtttacctaccctaaaatacgtaaaaaccctagaacgaaccccgaaggaaccaacgaacggccgttactatttacgtagtttagaaacgtccgaaggaccgaccggtaccgaaccccccaagtaccgaacctacccgttttaacgtaccggttacggggacccgggggtaacgacggtacggtaacggtaacccggttaccgttccgttaccgacgtccccgttaaccaaacccccggg

SEQ ID NO: 391076 - DNA, 843 bp, Homo sapiens
  misc_feature: GZ8MTXP02G238D.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgaccctgggtccgccgggctccgaggggagggactgggagtgggtctcgaagtatcggagcgtgggtggtgtctacgtttccgtacgggagtacgtccggtgaaacggggcccgcgtttccgacccgtacttttccccgaagggggtaacctaaagtttcccggaccgaaggggtaaaccctaaaaagtttgggtttttacccttaaccctaaaaacgttaacggtaaaaaaaccccgtttaggaaaaccggtaaacccccggtaaacggggaaacccgtaaaccgaaacggggtacccgggttaccttaaacgttttaacccgtttaaggtttttaacggaaaaacggttaccccgtaaacggggaaaccccgtaaacccggggttacccggtaaaaccccccccaagtaacccggtaaacccttaacccgttttaaacggttaaccggtttacggggggacccgggggtaaccgtaacgggttacggggtcggtaacccggttaccgttaccgtttccgaaccggtccccgttacccgaaaccccgg

SEQ ID NO: 391077 - DNA, 559 bp, Homo sapiens
  misc_feature: GZ8MTXP02F19TV.44.62.F07.1.454.CMB.2.raw
  modified_base (222)..(222): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggnaagtcagggcataaacagtgctttggcctggtatcagcagaaaccaggaaaactcctagaactcctgatctatgatcgcctcagtttgaagtgatccatcaagtcagcgcagtgatcgtgggacagtattcactctcaccatcagcagtcctgccagtccgtagtaagttatttacgacttaaactttacttactggtactacgtactttaagtttaacttaccctttacctactaccgttacgttaccgggacgggtaacggaacgtaagggtacgaacgtacgttaaaaccgaaacgtaaccgtggtacggtcgtacgactaccgtatcgtttcg

SEQ ID NO: 391078 - DNA, 639 bp, Homo sapiens
  misc_feature: GZ8MTXP02GXDT6.44.62.F07.1.454.CMB.2.raw
  modified_base (598)..(598): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccgggctccgaggggaggggactggagtgggtctcgaagtatcgggagctgggtggtgtctactttccgtacggagactccgtggaacggggccgctttccacctatttcccgaggggacaaagtttccgacaggtaaccaaaagtttcggtttacctaccctaaaatacgaaaaaccttagaacgacccgaggaacacgaggcgtactattactagtttagaaacgtccgaggaccacggtacgacccccagtcgacctaccgtttacgtacgttacgggggcccggggacncggtcggtcgaccgtcgtacttcgacgtcctaccgaacccg

SEQ ID NO: 391079 - DNA, 875 bp, Homo sapiens
  misc_feature: GZ8MTXP02GXZX4.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtcgtgggggggcctgattcggcctgggaggtccctgaccctctcctgtgcggcctctggattcacctttagtgcctatggcatgacctggtcccgccgggctccgaggggaggggactggagtgggtctcgaagtatcggagcgtggtggtgtctacgtttcccgtacgggagtactccggtgaaacggggccgccgtttccaacccgtacttttcccgaagggggtaaccaaacgtttccggactaacggggtaaacctaaaaacgtttacggttttaccctaacccgtaaaaagttaaccggaaaaaaaacccgtttaggaaaccgaaacccccgggtaaacggggtaaaacccgaaaccggtaaacggggtaccgggtttacccttaaaacgttttaacccgtttaggtttttaaccggtaaaaaacggtaccccggaaaacggggtaaacccccgtaaaccgggggttaccccggaaacccccccccgtaaaacggttaccggtaaaaccccgttaaacccggtttttaaaccgggttaaacccgggttttaccggggggggaccccggggggtaaacgtacggggttaccggggttaacggaaccccggtttcgttacccgtttaccggaccggtaccccgtaccccgtaaacccccggg

SEQ ID NO: 391080 - DNA, 795 bp, Homo sapiens
  misc_feature: GZ8MTXP02HD2KY.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggggcctgattcggcctgggaggtcctgaccctctcctgtgcgcctcgtggattcacctttagtgcctatggcatgaccgtgggtccgccgggctccggaggggagggctgggaggtgggtctcgaaggtagtccgggagcgtgggtggtgtctacgtttccgtacggacgtaccgtccggtaggaacggggtcccgtcgttcccgaccgtaacgttttcccgaagggggtaacctaaagtttcccggaccgtaaagggtaaaccttaaaacgttttcggtttttaaccctaaaccgttaaaaacttaacggtaaaaaaacccgttacgggaaaaccgggaaaccccggaaacggggtaaaacccaaaccggtaacggggttaccgtttaccgttaaaacgtttacccggtttaaggttttaaacgaaaacggtcccgtaaacgggaacccgaaccggttacccgaaccccctagtacgaacccttaccgtttacggtaaccggttcgggggacccggggtacgtacggtggtaacgacccgttcgttacctacgaccgtcccgtaccaacccgg

SEQ ID NO: 391081 - DNA, 562 bp, Homo sapiens
  misc_feature: GZ8MTXP02HMZOC.44.62.F07.1.454.CMB.2.raw
  modified_base (221)..(221): a, c, t, g, unknown or other
  modified_base (237)..(237): a, c, t, g, unknown or other
  modified_base (342)..(342): a, c, t, g, unknown or other
  modified_base (410)..(410): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctggtagggacagagtcacatcacttgccgggnaagtcaggcataaacngtgtctttggcctggtatcagacaagaaaccaggaaactcctagaactctagatcatgatgcctcgtagttaggaagtggactcccagtacacggtcacggcganaggtgatcgtaggactagtatttcactctacaccatcagcacgcctgacacgtcgtagtaaacgtttnttacgacttaactttagttacagtacgagttacgttaaactttaactaccttaccgtacttacgtacggttcggacgggtacggtaacgaagggtacgaactaacgtaaccgaaagtacgtcggtacgacgtacgacctacctagttactcg

SEQ ID NO: 391082 - DNA, 597 bp, Homo sapiens
  misc_feature: GZ8MTXP02F0EK9.44.62.F07.1.454.CMB.2.raw
  modified_base (381)..(381): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccgggctccgaggggaggggacgtggaggtggggtctacgaagtatcgggagcgtggtggtgtcactttctacggngactccgtggaacgggccgcttcgacctatttccgagggacaattcgacaggactaaattgtttactaccaaatagaaaactgacgaccgagacacaggcgtctatactgttagaacgcagaccacggtcacccccgatacgactacctttaacgtacgttcggggccggggacgacggtggtcgaccggtctcgttcgacggcctccgaaacccg

SEQ ID NO: 391083 - DNA, 670 bp, Homo sapiens
  misc_feature: GZ8MTXP02G4M60.44.62.F07.1.454.CMB.2.raw
  modified_base (272)..(272): a, c, t, g, unknown or other
  modified_base (276)..(276): a, c, t, g, unknown or other
  modified_base (285)..(285): a, c, t, g, unknown or other
  modified_base (387)..(387): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgctagttgttggagtcggtgggggggcctgagttcggccgtgggacggtccctgaccctctcctgtgcgctntggntcactttgngcctatggcatcgacctgggtcccgccggctccggaggggacgggacgtgggaggtgggtctacgaagtgtcggagcgtgggtgtgtctactttcgacgganactcggtagacggcctcttcacctattaccgagggactaagttccgacgaaggaactaaagttcgtttacctaacctaaaagtaacgaaaaccgtacgaaccgaacccggaacgaaccaacgaacggtacgttacttaattacgttagtttaagaaacgaccgaacgaccgtaccggtaccgacccccagtaccgaccgtaccgtttacgtaccggttacggggaccggggacgtacggtcggtaacgtaccgtctcgtacgaccgtcccgtaccgaacccgg

SEQ ID NO: 391084 - DNA, 692 bp, Homo sapiens
  misc_feature: GZ8MTXP02FWDZ2.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgtggagtcgtgggggggcctgattcggcctgggagtccctgaccctctcctgtgccggcctctggattcacctttagtgcctatggcatgaccgtgggtcccgccgggctccgaggggacgggctgggaggtgggtctcgaagtagtcgggagcgtgggtggtgtctactttcgtacggacgtactccggtaggaacgggccctcgttaccaacctagtttaccccgaaggggtaacctaaacgtttccgacgtaacggtaaactaaaagtttcgtttacctaacctaaaatacgtaaaaacctgaacgaaccccgagaacacgaggtcgtactattacgttagttacgaaagtccgaacgaccgacggtaccgaacccccatacgacctaaccgtttacggaccggttcgggggacccggggtaacgtcggttacgggtaacgtacccgttcgttccgttaccgacggtccctacccgaaacccgg

SEQ ID NO: 391085 - DNA, 779 bp, Homo sapiens
  misc_feature: GZ8MTXP02HN3OP.44.62.F07.1.454.CMB.2.raw
  modified_base (384)..(384): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtctttttaaagggtgtcgtgtgtgaagtgcagttgttggagtcgtggggggggcctggattcggcctgggaggtccctgaccctctcctgtgcggcctctggattcaccttagtgcctatggcatgacctgggtccgccgggctccgaggggaggggctgggagtggggtctcgaaggtagtcggagcgttggtggtgtcactttccgacgganacgtcgtggaacgggttcgcctttcaccctaattttcccgaaggggtactaaacgtttccgacgtaacgggtaactaaaagtttcgtttaccttaacccaaaacttaacggtaaaaaacccttacggaaacgttaacccccgaaagggtaaaccaaccgaagggtacccggtttacgttaaactttaaccgttaggttttaagaaaacgtacccgaacgggaacccccgtaaacggggttaccccggaacccccccctaaggttaccgaaacccgttaccccgttttaaaggtaacccggttttcgggggggacccggggggtaccgtaaggggtcggggttaacggtacccggttacgttaccgttccgacggtccccttacccgaaaccccgg

SEQ ID NO: 391086 - DNA, 875 bp, Homo sapiens
  misc_feature: GZ8MTXP02FMFZ6.44.62.F07.1.454.CMB.2.raw
  modified_base (282)..(282): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaagggtgtcgtgtgtgaagtgcagttgttggagtcgtgggggggcctgattcggcctgggaggtccctgaccctctcctgtgcggcctctggattcacctttagngcctatggcatgacctgggtccgccgggctccgaggggaggggactgggagtggggtctcgaagtagtcggagcgtgggtggtgtctacgtttccgacgggagacctccggtaggaacggggtcccgtcgtttccaacccgttatttaccccgaagggggtaacctaaacgtttccggaccgtaaacggggtaaaccctaaaagtttacggtttttacccttaaaccctaaaacgtaaacggtaaaaaaaccccgttacggaaaccggaaacccccgggtaaacgggtaaacccgtaaaccggaacggggtacccggttacctttaacgttttaaaccgtttaggtttttaacggaaaacggttacccggaaaccggggtaaacccccgtaaaccgggggttaccccgaaaccccccccgtaacgttaaacccggaaaccccgttaaacccggtttttaaaccggttaaacccggggtttaccgggggggtacccggggggtaaaccgtacgggggttacggggtaaccggttaaccccgggttccgtttacccgtttaccgaaccgggtccccttacccgaaaacccccggg

SEQ ID NO: 391087 - DNA, 583 bp, Homo sapiens
  misc_feature: GZ8MTXP02HA3X9.44.62.F07.1.454.CMB.2.raw
  modified_base (398)..(398): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggcttttttaaagggtgtcgtgtgtgaagtgcagttgttggagtctggggggggcctgattcggcctgggaggtccctgaccctctcctgtgcggcctctggattcacctttagtgcctatggcatgacctgggtcccgccgggctccgaggggaggggactgggagtgggtctcgaagtatcgggagctggtggtgtctactttcctacggagactccgtgaacgggccncttcaccatttccagggacaattcgcaggacaaattgttctaccaaatgaaaacctgaacgacccgaggacacagcgtactattactgtttagaaagcctaaggaccaacggtcgacccccatcgaccacctttacgtacgtcggggcggggacaggtggtcgacgtctcttcacgcctcaaccg

SEQ ID NO: 391088 - DNA, 686 bp, Homo sapiens
  misc_feature: GZ8MTXP02H78HI.44.62.F07.1.454.CMB.2.raw
  modified_base (351)..(351): a, c, t, g, unknown or other
  modified_base (407)..(407): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggagtcctgaccctctcctgtcgcggctcgtggattctaccttagcgtcctatggcatcgacctcgggtccgccgggctccggaggggagggacgtggagtgggtctcgaagtntcgggagcgtggtggtgtctactttccgacggagacctcggtaggaacgggtcccnctttaccgacctacgtttcccgaagggactaaagttccgacgtaaggaactaaagtttcgtttacctaacctaaaataacgaaaaacctgaaccgacccgaagaaccacgacggtcgtactattacgtagtttagaaactccgaacgaccaccggtcccgaaccccctagtacgaaccgttaccgtttaacgtaccggttcgggggaccggggtacgtaacgggttcggtaacggtacccgtacgtccgtaccgaccgtacccttacccgaaaccccgg

SEQ ID NO: 391089 - DNA, 622 bp, Homo sapiens
  misc_feature: GZ8MTXP02FZBAE.44.62.F07.1.454.CMB.2.raw
  modified_base (393)..(393): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggccgtgggacggtcctgaccctctcctgtgcgcctctggattcacctttagtgcctatgcatgaccgtgggtcccgccgggctaccgaggggaggggacgtgggaggtgggtctacgaagtgcgggagcgtggtggtgtctactttccgacggagactcgnggaacggccgtctccacctactttccgagggactaagtcgacaggaactaaatttcgttcctaacctaaataacgaaaaacctgaacgaacccgagaacacgaggcgtactattactgttagaacgacagaccacgtaccgaccccatacgacctacgttacgtacggtcggggaccggggacaggtcggaacgtacccgtcttacttcgacgtcctacccgaacccgg

SEQ ID NO: 391090 - DNA, 724 bp, Homo sapiens
  misc_feature: GZ8MTXP02H6AYF.44.62.F07.1.454.CMB.2.raw
  modified_base (282)..(282): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgtggagtctgggggggcctgattcggcctgggaggtcctgaccctctcctgtgcggcctctggattctacctttagngcctatggcatgacctgggtccgccgggctccgaggggagggacgtggagtgggtctacgaagtagtcggagtcgtggtggtgtcactttcccgacggtacgtacctccggtaggaacggggccctctttacgaaccctattttacccgaaggggacctaaatttccgactaaggaaactaaaatttggtttaccaccctaaaattaacgaaaaaccctgaacgacccgaaggaaccagtaggccgttataattaaccgtagtcgtagggaattggggtttacaagtttccgggccgaaaacggggtaaccccgttacggggttccaaacccggttcccgtaacccgttcccaaccggtcccgttaccccaaaaccccgaaaccgggggacccccaaacggttaccccgggttccctttacccccccgtcggggtccccccg

SEQ ID NO: 391091 - DNA, 808 bp, Homo sapiens
  misc_feature: GZ8MTXP02JU3HS.44.62.F07.1.454.CMB.2.raw
  modified_base (283)..(283): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagngcctatggcatgaccgtgggtcccgccgggctccgagggacggggacgtggaggtggggtctacgaagtagtcgggagtcgtgggtggtgtcgtactttccgacgggtagaccgtccggtaggaacggggccgtcctttaccacccgttactttacccgaggggtacctaatttccgacgtaacggtaactaaacgtttcgtttacctaacccgtaaaattaacgtaaaaacccgttacgaaaccggaaccccggtaaacggaaaccgaaccgaacgggtaccggttaaccttaaacgtttaacccgtttagtttaaacggaaaaccggtacccgaaacgggtaaccccgtaaccggggttaccccgaaacccccccgtaacgtaccggtaaaacccgttaaacccgttttaacggttaacccgggtttaccggggggacccgggggtaaccggtacggggttacgggtaaccggtaccggttccgttaccgtttccgacccgtcccgttaccccgaaaccccgg

SEQ ID NO: 391092 - DNA, 756 bp, Homo sapiens
  misc_feature: GZ8MTXP02IBSXZ.44.62.F07.1.454.CMB.2.raw
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctcctgtctgcatctggtaggggacagagtcaccatcacttggccgggcaaggtcagggacaataaacagtgtctttggcctggtatcagacaaggaaaccagggaaaacctccgtagaactctagatctatgactcgtcccttccgtaaggttttagggaaaagttcgggaacgttaccccgaagttaccggtaacgggtttacgaacggggtccgggacgtagggttagggaacgttccgggtacgggggtaactaacgggtttaactttttcccaacctttaccctaccaaacccttagtacccgaagccgaacggtcccttaggaccttacggacccgttaaggtaaagtttcggtttttacgaaacctttaaacgttttacgtttaccttacggtaactacgttaaccgttaaagtttttaaaccttaccctttaaccccttctaccgtttaccgggtttacccggggacggggttaacgggaaaccggttaaaggggttacggaaacgttaacgtaaccggtaaaaccgtaggttcgggtacggactaccgtacctaccggttaatcccggtttcg

SEQ ID NO: 391093 - DNA, 571 bp, Homo sapiens
  misc_feature: GZ8MTXP02FPO4L.44.62.F07.1.454.CMB.2.raw
  modified_base (243)..(243): a, c, t, g, unknown or other
  modified_base (380)..(380): a, c, t, g, unknown or other
  modified_base (389)..(389): a, c, t, g, unknown or other
  modified_base (394)..(394): a, c, t, g, unknown or other
  modified_base (398)..(398): a, c, t, g, unknown or other
  modified_base (405)..(405): a, c, t, g, unknown or other
  modified_base (424)..(424): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtcctccatcctccctgtctgcatcgtggtagggacagagtcaccatcacgttgccgggcaagtcagggcaataaacngtgcgtttggcctggtatcagcaacggaaaccaagggaaaacctccgtagaacctccgtagatctatgatcgccttcgaggtttaggaagtgactccatacgaagtcagcgacgtagtggatcggtagggactagtnttcacttcncaccntcancacgtcngcagtcctagaaacgtttntttacgacttaacttatacgtagtactagttacgttaactttaacttaccctttacctacttacgttacggttacgggacggtacggacgtagggacgtacgaacgtaacgaacgtagtcggtacgacgtcacctacgtacttcgtc

SEQ ID NO: 391094 - DNA, 573 bp, Homo sapiens
  misc_feature: GZ8MTXP02JFVIH.44.62.F07.1.454.CMB.2.raw
  modified_base (346)..(346): a, c, t, g, unknown or other
  modified_base (351)..(351): a, c, t, g, unknown or other
  modified_base (551)..(551): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggggacagagtcaccatcacttgccgggcaagtcagggcataaacagtgctttggcctggtatcagcagaaaccagggaaactcctgaactcctgatctatgatgcctcagttggaagtggatcccatcaaggttcagcgcagtgatcgtgggacagtattcactctcaccatcagacagcctgcacgcctagaatatttgactaacttntactntactagacttagtttaaactcctttaccctcttactacgtttccgggacggtaacgggtaacctaagggtcggaagtaacgtaaccgaaaacggtaaacgttcggtaacggtctagccctacgtaacttccgtcgttacttctactttcccgtccctactacttcgtactataaacttcttacgtcgtacgtgcgtcggngtcggtacgagacgtcgagtcg

SEQ ID NO: 391095 - DNA, 707 bp, Homo sapiens
  misc_feature: GZ8MTXP02F88M8.44.62.F07.1.454.CMB.2.raw
  modified_base (285)..(285): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtgggggggcctgattcggccgtgggacggtccctgaccctctcctgtcgcgcctctgattcacttagtncctatggcatcgaccgtcggcccgccggctccgaggggagggcgtgggaggtgggtctacgaagtgtcggagtcgtgggtgtgtctactttccgacggtacgactccggtagaaccgggccgtccttccaaccttacgtttacccgaagggactaaagttcgacgagtaactaagtttcgtttacctaactaaaagtacgtaaaaacctcgaaccgtaacccgaacgaacgacgacggtaccgttacttaacgtttacgttagtttaacgaaacggtaccgaacggtaacccgaaccgggtacccgaacccccgtaagtaccgtaaccgttaccgtttaacggtaccgggttacgggggacccggggacgtacggtcggtccgtacccgttctacgttccgacgtcccgtacccgaacccgg

SEQ ID NO: 391096 - DNA, 747 bp, Homo sapiens
  misc_feature: GZ8MTXP02I46YD.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggcctgattcggcctgggaggtccctgaccctctcctgtgcggcctctggattcacttagtgcctatggcatgaccgtggtccgccggctccgaggggacggcgtggacggtggtctcgaagtgtcgggagtcgtgggtgtcgtcgtactttccgtacggagtaccgtccggtaggaacggggccctcttccaccgtactttcccgaaggggactaacgttcgacgtaggtaacctaaagttcgtttacctaacccgtaaagtaacgtaaaaacctacggaaccgaacccggaacggaacccgaaccggaacggtaccgttacgttaacgtttacgttacggtttaacgaaaccggtaccgtaaccgggaacccgtaccggtacccgaaccccccgtagtaccgaaacccttacccgtttaacggttaccgggttacgggggacccggggtaaccggtacggtaacggggtccgtaacccggttccttaccgttaccgacccgtaccccgttaccgtaaacccccgg

SEQ ID NO: 391097 - DNA, 741 bp, Homo sapiens
  misc_feature: GZ8MTXP02I2NU8.44.62.F07.1.454.CMB.2.raw
  modified_base (387)..(387): a, c, t, g, unknown or other
  modified_base (405)..(405): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagcgcctatggcatgaccgtgggtcccgccgggctccgaggggaggggctgggaggtgggtcctcgaaggtacgtcggagcgtgggtggtgtctactttcgacgganactccggtgaacgggccncgttccacctactttcccgaggggtaactaacgttcgaccgaaggtaactaaagtttacgtttactacctaaaacgtaacgtaaaaacccttagaaacgaaccccggaaggaaaccgaaccgtaacggaccgttacgttaacgtttacgttacgtttaacggaaacgtaccgtaacgggaacccgtaccgggtaccgtaacccccccgtaagtaccgtaaccgttaaacccgtttacggttaaccgggttacgggggtacccgggggtaacgtacgggttacgggtccggtacccgttacgttccgtttaccgaaccggtccctacccaacccggg

SEQ ID NO: 391098 - DNA, 756 bp, Homo sapiens
  misc_feature: GZ8MTXP02F3APJ.44.62.F07.1.454.CMB.2.raw
  modified_base (283)..(283): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgtggagtcgtgggggggcctgattcggcctgggaggtccctgaccctctcctgtgcggcctctggattcacctttagngcctatggcatgaccgtggtccgccgggctccggaggggggactgggaggtgggtctacgaagtagtcggagcgtgggtggtgtcctacgtttcgaccggagtaccgtcggtacggaacgggcccgtcgttccaaccttacgtttaccgaacgggtaacctaaacgtttccgacgtaaagggtaactaaaattttcgtttaacctaaccctaaaagttaaacgaaaaacctgaaaccggaaccccgaaaggaaccaacgtacggaccgttacttaattaccgttaggtttagaaaacgtccgaacggacccgtaaccggtacccgaaccccctaagtccgtaaccttaacccggtttaacggtaaccgggttacggggggacccgggggtaacgtacggggttcgggtaccggtaacccggttccgttaccgttaccgaccgtcccccgtaacccgaacccggtaaacccggg

SEQ ID NO: 391099 - DNA, 780 bp, Homo sapiens
  misc_feature: GZ8MTXP02J1UVC.44.62.F07.1.454.CMB.2.raw
  modified_base (268)..(268): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggacggtccctgaccctctcctgtgcgcctntggattcacctttgtgcctagtggcatgaccctgggtcccgccgggcctccgaggggagggacgtgggaggtgggtctacgaaggttgcgggagcggttgggtggtagtcctacgttttcccgaacgggagtaccgttccggtaggaaccggggcccgtcttaccaaccctacgtttaccgaaggggaacctaaagttccgaccgtaacgggtaaactaaacgtttcgtttaccctaacctaaaacgtaaacgtaaaaacccgttacggaaccgaaccccggaacggaaccgaaccggacgggccgttacgttaagtttaccgttagttttacgaaacggtacccgaaccggtaacccgaacccgggttacccgacccccccgtaagtaccgaaaccgttaacccgtttaacgggttaccgggttacgggggtacccgggggtaccgtaacgggttcgggtaacgtacccggtccgttccgttaccgcccgtaccccgtacccgaaccccgg

SEQ ID NO: 391100 - DNA, 852 bp, Homo sapiens
  misc_feature: GZ8MTXP02G9482.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggtctttttaaagggtgtcgtgtgtgaagtgcagttgttggagtcgtgggggggcctgattcggcctgggaggtccctgaccctctcctgtgcggcctctggattctacctttagtcgcctatcggcatcgacccgtcgggtcccgccgggctccgaggggagggacgtgggaggtcgggtctcgaagtgtcgggagtcgtgggtggtgtctactttccgtacggacgtcctccggtggaacggggtcccgtcgttaccaccgtacgtttacccgaaggggtaacctaaagtttccgacgtaacgggtaaaccttaaaagtttcggtttaaccctaacccgtaaaaattaaccggtaaaaaaacccttcgggaaaaccggtaaacccccggaaaggggtaaacccaaaccggtaaacgggtaccgtttaaccgttaaacttttacccggttaaggtttaacggaaaacgacccggtaaacgggaaaccccgtacccgggttaaccccgaaacccccccgtaagttaaccgaaaccccgttaaacccggttttaaacgggttaccgggtttaccggggggtaccccgggggtaaaaccgtcggggtttaccggggtaaccggttaacccggttaccgtttcccgttacccggaaccggtcccccgttacccgtaaaacccccgggg

SEQ ID NO: 391101 - DNA, 649 bp, Homo sapiens
  misc_feature: GZ8MTXP02ISPLI.44.62.F07.1.454.CMB.2.raw
  modified_base (272)..(272): a, c, t, g, unknown or other
  modified_base (289)..(289): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcggtgggggggcctgattcggcctgggaggtccctgaccctctcctgtgcggctctggnttcactttagtgcctangcatcgacctggtcccgccggctccggaggggagggacgtggaggtgggtctcgaagtagcgggagcgtgggtggtgtctactttcgacggagaccttccggaggaacggggcccgtcttccgaacctactttccgaagggactaaagttcgacgaagaaactaatttcgttactactaaatacgaaaacctgaacgaccgagacacgacgcgtatattacttagttacgaaacgtccgacggaccaccggtaccgacccccacgtacgaacctaccgtttacgtaccggttacgggggcccggggacgtaggtacggtaaccggccgttacttcgtaccgcgtacctacccgaacccgg

SEQ ID NO: 391102 - DNA, 589 bp, Homo sapiens
  misc_feature: GZ8MTXP02HNL00.44.62.F07.1.454.CMB.2.raw
  modified_base (393)..(393): a, c, t, g, unknown or other
  modified_base (401)..(401): a, c, t, g, unknown or other
  modified_base (523)..(523): a, c, t, g, unknown or other
  modified_base (574)..(574): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctctggattcacctttagcgcctatggcatcgaccgtgggtcccgccggctccgaggggagggacgtgggaggtgggtctacgaagtgtcgggagcgtgggtgtgtctactttccgacggagctcggngacggccncttccacctatttccgagggacaattcgacagactaattgttactactaaatacgaaaactgacgaccgagacacgagcgttatattatagttagaacgccgacgaccgacgtccaccccancacctacttacgtacggttcgggccgggactaggtcgtcgcgtactctacnccgcctacaacccgg

SEQ ID NO: 391103 - DNA, 735 bp, Homo sapiens
  misc_feature: GZ8MTXP02GYDZY.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgctagttgtggagtcgtgggggggcctgagttcggccgtgggaggtccctgaccctctcctgtgcgcctctggattcacttagtcgcctatggcatcgaccgtgggtcccgccggctccgaggggagggactggagtgggtctacgaagtgcgggagcgtgggtggtgtctacgtttccgtacggagtaccgtccggtaggaacggggccgtcttccaacctagtttcccgaagggtactaaacgttccgacgaacgaaactaaagtttcgtttacctaacctaaaacgtaacgtaaaaaccgtacgaaacggaaccccgaacggaaccaacgaacggtacgttacgttaacttaacgttagtttaacgaaacgacccgaacggtaaacccgaccggtacccgaccccccgtaagtaccgtaaccctaaccgtttaacggtaaccgggttcgggggacccgggggtaacgtacgggtacggtaaccggtaacccgtccgttaccgttaccgaccgtcccgtacccgaaaccccggg

SEQ ID NO: 391104 - DNA, 853 bp, Homo sapiens
  misc_feature: GZ8MTXP02HDA0C.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgtggagtcgtgggggggcctgattcggcctgggagtccctgaccctctcctgtcgcggcctctgattctaccttagtgcctatggcatgacctggtcccgccggctccgagggagggactggagtggtctcgaagtatcggagtcgtggtggtgtcgtacttccgtacggacgtacctccggtaggaacgggccgtccgttaccgaacctacgtttacccgaacgggtaactaaacgttcccgacgtaaacgggaaacccttaaaagtttacggttttaccctaaacccgttaaaaacgttaaacggtaaaaaaaccccgttaagggaaaacccggtaaacccccggtaaacgggtaaacccgtaaacccggaaacggggtaccccgggtttaaccgtttaaaactttaacccgtttaaggttttaaaccggtaaaaaccggtaccccgaaaacgggggttaaacccccgaaacccggggtttaaccccggaaaacccccccctaacgttaaccggtaaaaccccttaaaccccggttttaaacggttacccgggtttacggggggaccccgggggtaaccgtaagggttacgggtaacgtacccgtcgttaccgtttaccgaccgtacccgtaccccgaaacccggg

SEQ ID NO: 391105 - DNA, 553 bp, Homo sapiens
  misc_feature: GZ8MTXP02FOFUE.44.62.F07.1.454.CMB.2.raw
  modified_base (346)..(346): a, c, t, g, unknown or other
  modified_base (387)..(387): a, c, t, g, unknown or other
  modified_base (410)..(410): a, c, t, g, unknown or other
  modified_base (459)..(459): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctgtaggggacagagtcaccatcacttgccgggcaagtcagggcataaacagtgctttggctggtatcagcagaaaccagggaaaactcctagaactctagatctatgatcgcctcgtaggtttaggaaaggtggacgtccatcgaacggttcagcgnaggtgatcgtagggactagtactttcactcacaaccatcancagcctgcagctagaaacgtttnttacacttaacttacttatagtactatacttaatttaactccttacctnttacgtacgttacgggacgggtaacggtacgtaagggtacgaactaaccgtaacgaaacgtacgtggtacgactacgacctactacgttctacg

SEQ ID NO: 391106 - DNA, 616 bp, Homo sapiens
  misc_feature: GZ8MTXP02JIBLD.44.62.F07.1.454.CMB.2.raw
  modified_base (239)..(239): a, c, t, g, unknown or other
  modified_base (397)..(397): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttgacccagtctccatcctccctgtctgcatctggtagggacagagtcaccatcacgttgccgggcaagtcaggcataaacngtgctttggcctggtatcagacaacgaaaaccgaagggaaaacctcctagaacctcctagatactatcgatcgtcctacgtaggtttaggaaagtggacgtccatacgaacggttcagcgacgagtggatcgtaggactagtacttcactctacaccntcgagcacgcctgaccgagtccgtagaagttatttacgactttaacgttattctagtactagtacttaagtttaaccttaccttaccctctaccgtaccgtttacggggaccggtaacgggtaaccgaaagggttacggaaacgtaacgttaaacccgaaaacggttaacgtcggtacgggtaacctaccggtacctaaccctacgtttccgtttaccg

SEQ ID NO: 391107 - DNA, 631 bp, Homo sapiens
  misc_feature: GZ8MTXP02IEU9Y.44.62.F07.1.454.CMB.2.raw
  modified_base (268)..(268): a, c, t, g, unknown or other
  modified_base (283)..(283): a, c, t, g, unknown or other
  modified_base (291)..(291): a, c, t, g, unknown or other
  modified_base (383)..(383): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcggtgggggggcctgattcggcctgggagtcctgaccctctcctgtgcggcctntggattcactttagngcctatgnatgactgggtcccgccgggctccgaggggagggactgggaggtggggtctcgaagtgtcggagtcgtgggtgtgtctacgtttccgacggancctcggtggaacgggccgtctttccactacgtttcccgaggggtacaagttcgacaggactaaattcgttacactaaatacgaaaactgacgaccgagacacgacgcgtactattacgttagttacgaacgctacggaccgtacggaccgacccccatacgactaccgtttacgtaccggttcgggggacccgggtagtacggtcggtaacgaccgtcgttacttccgacggtccctacccaacccgg

SEQ ID NO: 391108 - DNA, 707 bp, Homo sapiens
  misc_feature: GZ8MTXP02I7AXB.44.62.F07.1.454.CMB.2.raw
  modified_base (184)..(184): a, c, t, g, unknown or other
  modified_base (305)..(305): a, c, t, g, unknown or other
  modified_base (355)..(355): a, c, t, g, unknown or other
  modified_base (374)..(374): a, c, t, g, unknown or other
tcagacagtatatacacgaccggtgctcgatttagtagtcgcataaagggaaagggggagtcagacccactcaggacacagcatggacatgagggtcccccgctcagctcctggggcttctgctgctctggctcccaggggacagagtcaccatcacttgccgggcaagtcagggcaataaacngtgctttggcctggtatcagcagaaaccaggaaactcctagaactcctgatctatgatgcctcctagtttggaaagtggagtcccatcaaggttcagcggcagtcggatcgtaggacagtnttccactctcaacctatcaagcacgccctgaccacgtacctagaacgttnttttacgacttaaactttntaacgttcgtactacgtacttaacgtttaacttaccctttaccctacttccgtacgtttcggacggtacgggaaccgtagggtacggtagaacgttacgaaaccggtaaacgttcgggtacggtaccgttacgaccccgtaaccgttaaccgttaccgtttcggtttaaccctttcccgttaacctttcccccggttaacccccgtacccgtttaaacccttccggtttaacgttaacttaaacgtttaaccttaacgttttacggtaccgttacgggaccggggtaaccggtccggtaaggggtaccgaacgggtaccgacgttaaacggtg

SEQ ID NO: 391109 - DNA, 821 bp, Homo sapiens
  misc_feature: GZ8MTXP02HGGBA.44.62.F07.1.454.CMB.2.raw
  modified_base (186)..(186): a, c, t, g, unknown or other
  modified_base (378)..(378): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggngtcgtgtgtgaagtgctagttgttggagtcggtgggggggcctggattcggcctgggacggtccctgaccctctcctgtgcggctctggattctacttgcgcctagtgcatgaccgtgggtcccgcgggctccggaggggacgggacgtgggagtcgggtctacgaaggtacgtcgggagtcgtgggtggtntacgtactttccgtacggacgtaccgtcggtaggaaccggggccctccttaccgaaccttacgtttaccccgaaggggtaacctaaacgtttcccgacgaacggtaaaccttaaaacgtttcggtttacctaaacccgtaaaattaaaccgtaaaaaaccgttcggaaacccggtaaacccgaacgggaaaccaaccggtaacgggtacccggtttaacttaacgtttaaccgttagtttaaaccggaaacgtacccggaacggtaacccggtaaccgggttaccccgaaacccccctagttaacccgaaacccgttttacccgtttaaacgggttaaacccggggttccggggggaaccccgggtagtaacggggttccggtaaccggttacccgttaccgttcccgtttcgaacccggttcccctaccggtaaaccccggg

SEQ ID NO: 391110 - DNA, 642 bp, Homo sapiens
  misc_feature: GZ8MTXP02JBK5A.44.62.F07.1.454.CMB.2.raw
  modified_base (238)..(238): a, c, t, g, unknown or other
  modified_base (377)..(377): a, c, t, g, unknown or other
  modified_base (459)..(459): a, c, t, g, unknown or other
  modified_base (511)..(511): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgtggagtcgtggggggcctgattcggcctgggnggtccctgaccctctcctgtgcggcctctggattcactttagtgcatatggcatgaccgtcgggtccgccgggcctccgagggacgggacgtggagtggtctcgaagtagcggagcgtggtgtgtcacctttcacgganactcgtggaacgggcccgtcttaccaccgtacttccgagggtacactcgcaggactaattcgttctacaaatacgaaaaccngtaacgaaccgacgacacgacggctactacttaaccgtagtttacggaaacncgaacggacgaccggtaccgaacccccagtacgtaacctaccgtttaacgtaaccggttcgggggacccgggggtactacggggtcggtacggtacccggttcgtaccgtctaccggtaccctaaccccgg

SEQ ID NO: 391111 - DNA, 714 bp, Homo sapiens
  misc_feature: GZ8MTXP02JGYQB.44.62.F07.1.454.CMB.2.raw
  modified_base (282)..(282): a, c, t, g, unknown or other
  modified_base (419)..(419): a, c, t, g, unknown or other
  modified_base (655)..(655): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtccttttcttgtggtctttttaaagggtgtcgtgtgtgaagtgcagttgtggagtcgtggggggcctgatcggcgtgggacgtccctgaccctctcctgtcgcgcctcgtggacttcacctttagngcctatggcatcgaccgtcgggtcccgccgggctcccgaggggacggggacgtagggacggtgggtcgtacgaaagtacgtcgggagcgttgggtggtgtctacttcgtacggagtactccggtaggaacgggtccncttaccacctacgtttaccgaagggtactaaagttcgacgaacggaactaaatttcgtttactaacctaaaacgtacgaaaaaccgtgaaacgtacccgaagaaccaacgacggaccgttactaactttacgttagtttaagaaacgtccgaaacggtacccgtacggtacccgacccccgaagtaccgaaccgttaccgtttaacggtacggttacgggggacccgggggtaacncgggttacggtaaccgtaccggtactccgttaccgaccgtacccgtacccgaaacccgg

SEQ ID NO: 391112 - DNA, 662 bp, Homo sapiens
  misc_feature: GZ8MTXP02IPKPB.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgccttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgaccgtgggtcccgccgggcctcccgaggggaggggacgtggagtgggtctacgaagtatcgggagcgtgggtgtgtctactttccgacggagtacctccggtagaacgggcctcttcacctagtttcccgagggtacaagttcgacgaggactaattgttactacaaatacgaaaactgaacgaccgagacacgacgcgttactagttacttagttagaacgtccaacggtaccgaccggttaccgaaccccctagtacgaacccttaccgtttacggtaccggttacgggggtacccgggggaacgtacggttcgggtaacggtacccgttcgttccgttacgtaccggtaccctacccgaacccgg

SEQ ID NO: 391113 - DNA, 716 bp, Homo sapiens
  misc_feature: GZ8MTXP02GK0L7.44.62.F07.1.454.CMB.2.raw
  modified_base (269)..(269): a, c, t, g, unknown or other
  modified_base (278)..(278): a, c, t, g, unknown or other
  modified_base (288)..(288): a, c, t, g, unknown or other
  modified_base (322)..(322): a, c, t, g, unknown or other
  modified_base (338)..(338): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgctagttgttggagtcgtgggggggcctgattcggcctgggagtccctgaccctctctgtgcgcctctgnttcacttgngcctatcggnatcgaccgtgggtcccgccgggcctccgaggggngggctggaggtggtcnctaaggtgcggagtcgtggtggtgtcctacgtttccgtacggacgtacctccggtaggaacgggtccgtcgtttccaccttatttacccgaggggtaactacgtcgtacaaggaaccttaaattcgtttactactaaatacgtaaaacctagacgacccgaaggacacgaggcgtactacttacgttagtttacgaaacgtccgaaacggtaccgtaccgggtaccgaaccccccgtataccgtaacccgttaacccgttttacggggttaaacccggtttcgggggggacccgggggtaacgtacggggttacgggtaaccggtaccccggttacgttcccgttaccgtaaaccggtccccttacccgaaccccggg

SEQ ID NO: 391114 - DNA, 732 bp, Homo sapiens
  misc_feature: GZ8MTXP02ICB85.44.62.F07.1.454.CMB.2.raw
  modified_base (282)..(282): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggagtccctgaccctctcctgtgcgcctctggattcacctttagncctatggcatgacctgggtcccgccgggctccgaggggaggggactggagtggggtctgaagtagtccgggagtcgtgggtggtgtctacgtttccgtacggtagtaccgtccggtaggaacggggcccgtcgtttccgaacccttacgtttcccgaggggtactaagttccgacgtacggaactaaacgtttgtttacctaacctaaactaacgtaaaacctaggaaccgacccgtagaaccacgacggacgttactaatttacgttagtttacgaaacgaccgtaggaacccgtaccggtaccgaaccccccgtagttaccgaacccttaccgttttaacggtaccggttaccgggggtacccgggggtaaccgtacggggttacgggtaacggtaaccccggttcgttacccgtttaccgaccgtaccccgtacccgaaaccccggg

SEQ ID NO: 391115 - DNA, 705 bp, Homo sapiens
  misc_feature: GZ8MTXP02GW6ZB.44.62.F07.1.454.CMB.2.raw
  modified_base (230)..(230): a, c, t, g, unknown or other
  modified_base (247)..(247): a, c, t, g, unknown or other
tcagacagtatatacacgaccggtgctcgatttagtagtcgcataaagggaaagggggagtcagacccactcaggacacagcatggacatgagggtccccgctcagctcctggggcttctgctgctctggctcccaggtgccagatgtgccatccacttcgacccagtcctccactccctccctgtctgctatcgtggtaggggacagacgtcaccatcacgtggccggnaagtcgaggcaataacngtgtcgttggctgtatcagacaacgaaaccgaaggtaaaacctccgtagaacctctagtactactagtacgtactcgtacccgttacgtagggtttaagggaaacggttcgaaccgtaccaagttacgaacggttaccgacggtcggacgtaggtacggacttcggggtacgaactacggttacctttccaccttcctaaccaacctactaccgagacccggtactcccgtagacctcggtaacgtaaggttacgttattttaacaaccctttaaatttacgttatacgtacaagttacttaaactttaacctaccctttacctgtacccggtttaggtaccggggaacggtaccgggtaaacggtacgggtagtaaaccgtaaccgtaaaacggtaccgttaacgtgggtacccgtacggttaaaccgtacctacgtttaaccgttacggtttaccc

SEQ ID NO: 391116 - DNA, 739 bp, Homo sapiens
  misc_feature: GZ8MTXP02FRNCF.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgctagttgtggagtcggtgggggggcctgattcggcctgggacggtcctgaccctctcctgtgcggcctctggtattcacctttagtcgcctagtggcagtcgacctggggtcccgccgggctccgaggggacggggacgtgggaggtcgggtctcgaagtagtcgggagcgttggtggtgtctactttccgacgtagactccggagaacgggcctcgttcacctacgtttaccgaggggtaactaaacgttccgacgaagggtaaacctaaagtttacggtttactaaccctaaaataccggtaaaaaacctacggaaacggaaaccccggaagggaaacccaaccgtaacgggtaccgttaccgtaacgttttaaccgttagtttaagaaacggtacccgtaaacgggtaaccgaccgggtaccaaccccccgtaagtaccggtacctaaaccgtttacggtaaccggttacgggggtaccgggggactaggtcggtaacggaccgttctaccgttcacggtcccttacgaacccgg

SEQ ID NO: 391117 - DNA, 717 bp, Homo sapiens
  misc_feature: GZ8MTXP02GU18J.44.62.F07.1.454.CMB.2.raw
  modified_base (270)..(270): a, c, t, g, unknown or other
  modified_base (286)..(286): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgctagttgtggagtcggtgggggggcctgagttcggccgtgggacgtcctgaccctctcctgtcgcgctntggattcacctttagntcctagtgcatcgaccgtgggtcccgccgggctccggaggggacgggactgggagtgggtctacgaaggtagcgggagcgtgggtggtgtctactttccgtacggacgtacgtccgtggaaccgggccctcgttcaaccttacgtttacccgagggtactaaagttcgacgaaggaaactaaaagtttcgttactaaccctaaaagtaaccgtaaaaaccgtagaaccggaaaccccgtaaggaaacccaacgaacgggtaccgttacgtaactttacgttagtttaagaaacgtacccgaacggtaacccgaccggtacccgaacccccaagtacgaccctaaaccgttttacggacggttccgggggaccgggacgtacggttcggaacgtaccgttcgtccttacgacgtcccgtacccgaaacccgg

SEQ ID NO: 391118 - DNA, 687 bp, Homo sapiens
  misc_feature: GZ8MTXP02G46E5.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgctagttgttggagtcggtgggggggcctgagttccggcgtgggacggtccctgaccctctcctgtgcgcctctggtattctacttagtgcctagtcggcagtcgaccgtcgggtcccggcccgggctccggaggggagggacgtgggaggtcgggtctacgaaggtagtcgggagtcgtgggtggtgtcgttacgtttccgtacggacgtacgtccggtaggaacgggcctccttaccaccgtacgtttaccgacgggaactaacgttcgacgaaggtaacttaaagttcgtttactaactaaaagtaacgaaaacctggaaccgaaccgaaggaccacgtacggacttagtaactttacgtagttaagaacgaccaaggaccctacggtacccaccccgaagtccgtaacctacgtttacggacggttacgggggccgggtacgaggtcggtcgtaccgtctactacgcgcccctacgaacccgg

SEQ ID NO: 391119 - DNA, 663 bp, Homo sapiens
  misc_feature: GZ8MTXP02JQCOR.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgtggagtgtggggggctgatcggctgggagtccctgaccctctcctgtgcggcctcgtggattcacctttagcgtcctagtcggctagtcgaccgtcgggtccgaccgggtcgtacccggaggggacggggtacgtgggaggttggtcctagtaaggtagtcgggtagtcgttgggtgttgtcttacgtttcccgtacggacgtacgtccggtagacgggcctcctacgacctagttccgagggtacaaagttcgacgaggtaactaagttcgttactaacgtaaataacgaaactgacgtacccgagacacgagctacttattacgtagttaacgaagtccgaagtccgaacgggtcccaaccccgtatacggtaccttacggttacgtcgggtaccggggcgggtaacgtcggtacggtcgtaccgtcgtcctacgaccgccgtacccgaaccgg

SEQ ID NO: 391120 - DNA, 689 bp, Homo sapiens
  misc_feature: GZ8MTXP02FXHLS.44.62.F07.1.454.CMB.2.raw
tcagacagtatatacacgaccggtgctcgatttagtagtcgcataaagggaaaggggagctctgagagaggagcccagcccctgggattttcaggtgtcttcatttggtgaccaggaccgaacagagagaagtctccatggagtttgggctgagctgtcctttttcttgtggtcttttttaaagggtgtcgtgtgtgaagtgctagttgttggagtcggtgggggggtcctggagttcggccgtgggacggtccctcgaccctctccgtgtcgcggcctcgtggtacttcctacctttagtcgtcctagtgcatcggaccgtcgggtcccggccgggtctccggaggggacggggcgtggaggtcggtctacgaagtgtcggagcgttgggtggtgtcgtacttccgtaacggtacgtacgtccggtaggaaaccgggtccgtcgtacctaacctacgtttacccgaaggggtaactaacgttccgacgaaggtaaacctaagtttcgttaccctaactaaaagtacgtaaaaaccgtgaacgacccgaagaccaacgaggtctactattacgtagttagaacgacgacggtaccacggtaccaccccgagtacacgttaccttacggtacggtcgggggacgggtacaggtcggtaacgtccgtctacgtcacgtcccgtcgaacccg

SEQ ID NO: 391121 - DNA, 840 bp, Homo sapiens
  misc_feature: GZ8MTXP02HLTGW.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgctagttgttggaggtcggtgggggggcctggatcggccgtgggacggtccctgccctctctgtcgcgctcgtggtacttcactttagcgtcctagtcggcatcgaccgtcgggtcccgccgggctccggaggggacgggtcgtgggaggtcggtctacgaagtacggtcggagtcgttgggttacggtcgtccgttacgtttcccggtaaccggtacgtaccgttccgggtaggtaacggggttctcccgttaaccaacccgttagtttacccggaaacgggtacctaaacgttcccggacgtaaacggtaaacttaaaacgttttcgtttaacctaaacccgtaaaagtttaaaccggaaaaaccgttacggaaaccggaaccccggtaacggaaaccgtaaccggtaaacggtacccgtttaacgttaaacgtttaccgttaacgtttaacggaaaaccgtaccggaaacggtaacccgaccgggttaccccgaaaccccccgtaagtaaccgttaacccgttaaccgtttaaacggttaccgggttaccgggggaccgggggtacgtaaccggggttcgggtaaccgtaccgttaccgttaccgttaccgaccgtaccccgtacccgtaaacccgg

SEQ ID NO: 391122 - DNA, 772 bp, Homo sapiens
  misc_feature: GZ8MTXP02GUY2B.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgcagttgtggagtcggtggggggcctgattcggcgtgggacggtcctcgaccctctccgtgtcgcggcctcgtggtacttctacctttagtcgtcctatggcatcggaccgtcggggtcccgccgggcctccggaggggacgggacgtgggaggtcgggtctacgaaggtagtacgggagtcggttgggtggtcgtcgttacgtttccgtacgggacgtacgtccggtagggaaccgggtcccgtccttcgaaccgtactttaccgaacgggaactaacgttcgacgaacggtaaacttaaaactttcgttaaccttaacctaaaataacgtaaaaaccgtcggaacgaaaccccgggaggaaacacgaacgggcttaactactttacgaggtttaaacgaaacggcccgaacggtaacccgaccgggtaccccgacccccctaagtacccgtaaccgtttaaccgtttaccggtaccggggtttaccggggggacccgggggtaacgtaggggtaccggtaacggtaccccggtcttaccgttcgaccggtaccccctaccggaaaccccgg

SEQ ID NO: 391123 - DNA, 903 bp, Homo sapiens
  misc_feature: GZ8MTXP02JG9UY.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaaggtgtcgtgtgtgaagtgcagttgtggagtcgtgggggggcctgattcggccgtgggacggtccctgaccctctcctgtgcgcctctgattctacttagtgcctatggcatgaccgtcgggtccgccgggctccgaggggacggggacgtgggaggtgggtctcgtaagtagtacgggacgcgtgggtggttgtgtacccccccccgtttgtaccggtagtacctaccggttacgggaacggggcccgtccgtttacccgtaacccgtaaccgttttaccccggaaacggggtaaccgtaaaacgtttacccgggaacgtaacggggtaaaacccttaaaagttttaccgggttttaaccctttaaacccctaaaaaagtttaaaccggtaaaaaaaaccccgtttacgggtaaaaccggtaaaacccccggggtaacgggtaaaacccgaaaccggtaaaccggggtaacccggtttaaccgttaaaacgttttaacccgggtttaagtttttaacggaaaacgtaacccggtaaacgggaacccggtaaaccgggtacccggtaaccccccctaacgttaccgtaaacccgttaaacccggttttacgttaaccgggtttaccgggggtacccgggggtaacggttaacggttacggggtaacggtaacccggttccgttaccgttcccgtaaccgtcccgttaccccgtaaaccccggg

SEQ ID NO: 391124 - DNA, 844 bp, Homo sapiens
  misc_feature: GZ8MTXP02JE6QD.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtcttttttaaagggtgtcgtgtgtgaagtgcagttgttggagtcgtggggggcctgattcggccgtgggacggtccctgaccctctcctgtcgcggtcctctggtattctacctttagtgtcctagtggcagtcgaccgtcgggtcccgccgggtctccggaggggacgggcgtgggaggtgggtctcgaagtacgtcgggagtcgttggtcggtcgtcgtactttccgtacggtacgaccgtaccggtggaacggggtcccgtccgttaccgaaccctacgtttacccgaaggggtacctaaacgtttcccgacccgtaaagggtaaccttaaaagtttcggtttaacccgtaacccgtaaaaattaaccgggtaaaaaaacccgttcggaaaacccgggtaaaccccgggaacggaaaacccgaaacccggtaaaggggttcccgttaaaccgttaacttttaaccgttaaggtttaaccggaaaacggtcccgtaaacccgggaacccgtaaccggtaacccccgaaaccccccgtagtaaccggtaaaccccttaccggttttaaacgggtacccggttaacgggggggtacccgggaaccgttaagggtccgggtaacggtacccggttcttacccgtacgtaccggtacccctacccgtaaacccgg

SEQ ID NO: 391125 - DNA, 781 bp, Homo sapiens
  misc_feature: GZ8MTXP02F55JP.44.62.F07.1.454.CMB.2.raw
  modified_base (282)..(282): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgtggagtcgtgggggggcctgattcggcctgggaggtccctgaccctctcctgtgcggcctctggattcacctttagngcctatggcatgacctgggtccgccgggctccgaggggaggggactgggaggtgggtctcgaaggtatcgggagcgtgggtggtgtcctacgtttccgtacgggagaccgtccggtaggaacgggttcgtcgttccaaccctagttttaccccgaaggggtaactaaacgttccgacgtacggtaacctaaaagtttcgtttacctaaccctaaaagtaacgtaaaaaacctacgtaaacgtaaccccggaagaaaccgaaccgaacgggtaccgttacctaacgtttaaccgttaggtttaacgaaaacgtcccgtaacgggaaccccgtaccgggtacccgaacccccccgtaagttaccgtaaacccttaacccgttttaacggttaaccggttacggggggtacccgggggtaaccgtagggttaccggggtaacggtaaccccggttccgttacccgtttaccggaccgtaccccgttaccccgaaaccccggg

SEQ ID NO: 391126 - DNA, 950 bp, Homo sapiens
  misc_feature: GZ8MTXP02HJ9Z7.44.62.F07.1.454.CMB.2.raw
  modified_base (285)..(285): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgggaacagagagaagtctccatggagtttgggctgagctgcctttttcttgtggtcttttttaaagggtgtcgtgtgtgaagtgcagttgttggagtcgtgggggggcctgattcggcctgggagtccctgaccctctcctgtgcggcctctggattcacctttagngtcctatggcatgacctggtcccgccggcctccgaggggacggggactgggagtggggtctcgaaaggtagtcgggagtcgtgggtaggtcgtctactttccgtacggtagacctcccggtaggaacggggcccgcctttccgacctagttttccccgagggggtaacctaaagtttcccgaccctaaggggaaaaccttaaaagtttcggttttaacccttaaccccgtaaaaaagttaaaccgggtaaaaaaaaccccttacggaaaaccggtaaaccccggaaaccgggaaacccgaaaccgtaaacgggggtccccggtttaacctttaaacgttttaacccgtttagttttaaacgggaaaaacccggttaaccccggaaacggggtaaacccccggtaaaacccggggttaccccgggaaaaccccccccctaaagttaccccgggtaaaaccccgtttaaaacccccggtttttaaaccggttaaacccgggggtttttaacccgggggggggaacccccgggggggtaaaacccgtttaaccgggggttacggggttaaccggggtttaaacccccgggtttccccggtttaacccgtttaccccggttaaccccggtaccccccggtttaaaaccccgtaaaaacccccccggggg

SEQ ID NO: 391127 - DNA, 662 bp, Homo sapiens
  misc_feature: GZ8MTXP02FM9YX.44.62.F07.1.454.CMB.2.raw
  modified_base (293)..(293): a, c, t, g, unknown or other
  modified_base (368)..(368): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtggggggggcctgagttcggccgtgggacggtccctgacccctctcctgtcgcggcctctggacttcacctttagtcncctatggcatgacctggtccgccggctccgagggagggcgtggagtggtctcgaagtagcgggagcgtggtggtntctacgtttccgacggagacttccggtgaacggccgtctcacctattccgaggactaagtcacgagactaaagttcgttactaccaaatacgaaaacctgaacgtaaccgaacggacaccgagacgtactaatttacgttgtttacgaaagacgaacggaccacggaccgacccccgagtacgtacgtaccgtttaacggtaacggttaccgggggaccggggtaccgagggttacgggtcgtaacccggttcgttaccgtttccgaaccggtcccgttaccccgaaacccggg

SEQ ID NO: 391128 - DNA, 740 bp, Homo sapiens
  misc_feature: GZ8MTXP02GJA1J.44.62.F07.1.454.CMB.2.raw
  modified_base (200)..(200): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctcatggagtttgggctgagctgtcctttttcttgtggtctttttaaagggtgtcgtgtgtgaagtgntagttgtggagtcggtgggggggctgagttcggccgtgggacgtcctgaccctctcctgtcgcggctcgtggacttctactttagctcctagtcggctatcggaccgtggggtcccgccgggctaccggaggggacgggacgtgggaggtgggtctacgaagtagtcgggagcgtgggtgtgtctacgtttccgtaacggacgtacgttacggtaggaacgggttcctccttaccaaccgttacgtttacccgaaggggtaactagttccgacgaacggtaaactaaagtttcgttactaacctaaaagtacgaaaaacgtgaaccgaccgaacggactaacgacggtacgtacgttatttaacgtaggttaaacgaaacgtaccgaaggtaaccctaccgggtacccaaacccccgataacgtaacccgttaaccgtttaacggtaaccgggttacgggggacccggggtaacgtacgggttacgggtaaccggtacccgttcgttccgtaccgccgtacccgttaccgtaaacccggg

SEQ ID NO: 391129 - DNA, 796 bp, Homo sapiens
  misc_feature: GZ8MTXP02HD0VB.44.62.F07.1.454.CMB.2.raw
  modified_base (200)..(200): a, c, t, g, unknown or other
  modified_base (267)..(267): a, c, t, g, unknown or other
  modified_base (271)..(271): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctcatggagtttgggctgagctgtcctttttcttgtggtctttttaaagggtgtcgtgtgtgaagtgntagttgtggagtcggtgggggggctgattcggccgtgggacggtcctcgaccctctcctgtgcgctntggntctacttagtcgcctatggcatcgaccgtcgggtccgccgggctccggaggggaggggacgtgggaggtcgggtctacgaagtagtcgggagcgtgggtggtgtcgtactttccgtacggacgtacgtccggaggaacggggcccgtcttaccgaactcgtttaccgaagggtaacaacgtttcgactaagggaaactaaaagtttcggtttactaacctaaaagttaaacgtaaaaaaccgtacggaaacgaaaccccggaaaggaaaccgaaacggaacggggtaccttaacgttaaactttacggtttaacgtttaaacggaaaacgacccgtaaacgggaaaccccgtaaccgggttaaccccgaaccccccgtaaatacccggtaaacccttaacccggttttaacggttaaccggggttaccggggggaacccgggggtaacggtaacgggttcggggtaaccggtacccgtttaccgttcccgttaccgtaccggtccccttaacccgaaaccccggg

SEQ ID NO: 391130 - DNA, 754 bp, Homo sapiens
  misc_feature: GZ8MTXP02FZB5M.44.62.F07.1.454.CMB.2.raw
  modified_base (320)..(320): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttctgtggctttttaaaggtgtcgtgtgtgaagtgcagttgttggagtcgtgggggggcctgattcggcctgggaggtccctgaccctctcctgtcgcggcctctggattcacctttagtgcctatggcatgacctgggtccgccgggcctccgagggngggactggagtgggtctcgagtagtcgggagcgtgggtggtgtcactttcccgtacggacgtactcccggtaggaacggggccgtcctttcgaccctacgtttcccgaaggggtacctaattccgcgaagggtaaccctaaaagtttcgtttacttaccctaaaatacgtaaaaacctacggaacgtaacccggaaggaaaccgaaaccgaacgggaccggttaccttacgtttaaccggttagttttacggaaaacggttacccgaagggtaaccccgtaccgggtaccgaacccccccgtagtaccgtaacctaacccgttttaaacggtacggtttaccgggggtcccgggggtaaacgtacgggtacggtaacggtaacccggttccttaccggttacccgtacgtccccgtttacccgtaaaccccggg

SEQ ID NO: 391131 - DNA, 754 bp, Homo sapiens
  misc_feature: GZ8MTXP02GS0OO.44.62.F07.1.454.CMB.2.raw
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggtctttttaaagggtgtcgtgtgtgaagtgctagttgtggagtcggtgggggggcctgacgttcgggccgtggggacggtccctcgtaccctctccgtggtcgccggcctcgtggtacttccacccgttttagtcgtaccctagtcggctagtcggtacccgtcgggtccccggcccgggtaccgtccccggaagggggtacggggtaccgtaggggtaggtcggggtaccttacgaaaggttacggtccgggaggtcggttgggtggtgtcgtacgtttccgtacggacgtaccgtccggtaggaacggggtccctcgttaccgaccttacgtttccgaacgggtactaaacgttcgacgaacggtaacttaaagttcgttacctaccgtaaaataacgaaaacgtacgaacgaccgaacgaaccacgtacggcttatacttacgttgttacgaacgtaccgaacggacccgtaccggtaccaacccccgtgtaccgaccgttacgtttacggtacgggtaccgggggtcgggacgtaggtcggcggtacgtccttcgtcctaccggtcccaccgtaacccgg

SEQ ID NO: 391132 - DNA, 591 bp, Homo sapiens
  misc_feature: GZ8MTXP02IZBGF.44.62.F07.1.454.CMB.2.raw
  modified_base (102)..(102): a, c, t, g, unknown or other
  modified_base (235)..(235): a, c, t, g, unknown or other
  modified_base (239)..(239): a, c, t, g, unknown or other
  modified_base (254)..(254): a, c, t, g, unknown or other
  modified_base (276)..(276): a, c, t, g, unknown or other
  modified_base (284)..(285): a, c, t, g, unknown or other
  modified_base (287)..(287): a, c, t, g, unknown or other
  modified_base (290)..(290): a, c, t, g, unknown or other
  modified_base (324)..(324): a, c, t, g, unknown or other
  modified_base (348)..(348): a, c, t, g, unknown or other
tcagacagtatatacacgaccggtgctcgatttagtagtcgcataaagggaaagggggagtcagacccactcaggacacagcatggacatgagggtccccgntcagctcctggggcttctgctgctctggctcccaggtgccagatgtgccatccacttgacccagtctccatcctccctgtctgcatctgtagggacagatccaccatcacttggccgggcaagtcagggacanaacngtgcttggcctggtntcagcagaaaccaggaaactcngaactctnntnatnatcgctctagttagaagtgactccatcgaggtcnggacgcgagtggatggtgacagtnttcactcgtctaccatccaggtaccacggacctgtccaaggtcccttacgtaagttagttttaccgtaactaccctttaaagtttaccctggttcctaaacgtcgttaaacctttagtttaaccccttaacccgttcgttaccgttacgttacccggtacgggttaacggggacccgtaaaggggttagaaggtaccttaacgaaccgtagtaagacgggtctacgctacccgtatacgtttc

SEQ ID NO: 391133 - DNA, 832 bp, Homo sapiens
  misc_feature: GZ8MTXP02I2XDK.44.62.F07.1.454.CMB.2.raw
  modified_base (287)..(287): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgtcctttttcttgtggcttttttaaagggtgtcgtgtgtgaagtgcagttgtggagtcgtggggggcctgattcggcctgggaggtccctgaccctctcctgtgccgcctcgtgattcacttagtcgcctanggcagtcgaccgtcgggtcccggccgggtcctaccggaggggtacggggacgttagggaggttcgggtaccgtacgtaaggttacgtccgggacgtccggttggggttggttcgtacgttacgtttacccgtacgggacgttaccgtccgggtaggtaaacccggggtcccgtcgtttacccgacctacgttttacccgaaggggtaacctaaagttcccgacgtaacgggtaaactaaacgtttcggttacccttaaccgtaaaaacgtaccgtaaaaaccgtcggtaaaccgaaacccgggtagaaaccgaaccggtaaacgggtacccggttttacttaaccgtttaacggtttacggtttaaacggaaaacgtacccggtaaccggaacccgtacccggggtaccctaaccccccggtataaccgtaccgttacccgtttacggtaccgggttacgggggtaccccggggtacgtacggttacggttaaccggaccgtttccgttacccgttcgtacccgtaccccttaccgaaaccccgg

SEQ ID NO: 391134 - DNA, 635 bp, Homo sapiens
  misc_feature: GZ8MTXP02IZOPE.44.62.F07.1.454.CMB.2.raw
  modified_base (346)..(346): a, c, t, g, unknown or other
  modified_base (352)..(352): a, c, t, g, unknown or other
  modified_base (403)..(403): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtcgtgggggggcctgattcggcctgggaggtccctgaccctctcctgtgcggcctctggattcacctttagtgcctatggcatgacctgggtcccgccgggctccgagggagggactggagtgggtctcgaagtntcgggngcgtggtggtgtcactttccctacggagaccttcccgtagaacggggcccncgttccaccctatttccccagggggaactaagtttccgacaggaacctaaattcgtttactaccaaaatacgaaaacctgaacgacccgaggacacgaggacgtctatttacgtagttacgaaacgtccgaacggaaccgtacggtaccgacccccatacgacctaccgtttacgtacggttcggggaccggggacgaggtcgtcgaccgtctcgtcacgacctccaacccg

SEQ ID NO: 391135 - DNA, 650 bp, Homo sapiens
  misc_feature: GZ8MTXP02GWWC4.44.62.F07.1.454.CMB.2.raw
  modified_base (370)..(370): a, c, t, g, unknown or other
  modified_base (381)..(381): a, c, t, g, unknown or other
tcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcggcctgggaggtccctgacccctctcctgtgcggcctctggattcaccctttagtgcctatggccatgaccgtggtcccgccgggctccgagggagggacgtggagtggggtctcgaagtagcggagcgtgggtgtgtacnctttcacgganaccgtcgtggaacgggccgcgttacactaactttccgagggacaagttcgacgagaacaaaattgtttactaccaaatacgaaaactgaaccaccgagacacagcgtgtacttactgttagaaagaccagaaccgtacggtacgaccccccgaagtccgaaaccgtacctttaacggttaccgttacgggggaccgggggaacgtacggttacggggtaacgtacccggttcgttacgtttccaacggtccccttacccgaaaccccgg

SEQ ID NO: 391136 - DNA, 616 bp, Homo sapiens
  misc_feature: GZ8MTXP02IN6NH.44.62.F07.1.454.CMB.2.raw
  modified_base (260)..(260): a, c, t, g, unknown or other
  modified_base (262)..(262): a, c, t, g, unknown or other
  modified_base (271)..(271): a, c, t, g, unknown or other
  modified_base (278)..(278): a, c, t, g, unknown or other
  modified_base (307)..(307): a, c, t, g, unknown or other
  modified_base (310)..(310): a, c, t, g, unknown or other
  modified_base (316)..(316): a, c, t, g, unknown or other
tcagacagtatatacacgaccggtgctcgatttagtagtcgcataaaagggaaaggggagctctgagagaggagcccagccctgggattttcaggtgtcttcatttggtgaccaggaccgaacagagagaagtctcatggagtttgggctgagctgtcctttttcttgtggtcttttttaaagggtgtcgtgtgtgaagtgcagttgtggagtgtgggggggctgatcggcctgggagtcctcgacctctctgtgcgctngnttcacttgnctatgcntgacgtggtccgcggctccgaggcgggcnggngcggtntcaagtgcgagctgggtgtgctactttcgacgagactcgtagacggcgtcttcacctagtttaccgacgggtaactaagtcgacagactaaattgttctactaaatacgaaaacgtgaacgaaccgaggaaccacgacgtcgtacgttacttacgtagtttagaacgtaccacgggtaaccgaccggtaccgaacccccgactacggacttaccgttaacggttaccggttacgggggaccggggacgtcggtcggttgaacccgttgtaccgtaccgaacgtccgtacccgaaacccgg

SEQ ID NO: 391137 - DNA, 535 bp, Homo sapiens
  misc_feature: GZ8MTXP01CMF4W.39.81.H04.1.454.CMB.2.raw
  modified_base (343)..(343): a, c, t, g, unknown or other
  modified_base (365)..(365): a, c, t, g, unknown or other
  modified_base (429)..(429): a, c, t, g, unknown or other
  modified_base (502)..(502): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctcagggcagngtcaccatgaccacagacacatccacgagcacggcctacatcggacctgagagcctggagatcngacgacacggccgtgtattactgtgcgaagaggagtacgggggaaattagttttgacgttgggttaccccttnttgaactacgtggggccaagggaacccgtcggg

SEQ ID NO: 391138 - DNA, 545 bp, Homo sapiens
  misc_feature: GZ8MTXP01BJ6MJ.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagaggccaggccaaatctccaaggcgaccttaaatttataaggtttcctaaaccgggactcgtggggtcccagacagattcgagcggcaaggtgggtcagggcactgaattcacactagaaaatcagcgagggtggaggctgaggattggttggggtttattacgtgggcagtgacgaaaggaacacacgtcggcctccgtactacgtttggccgacggggaccaaggcgtaggagacgttcgaaacgaactggtcggctgacaacgaagtc

SEQ ID NO: 391139 - DNA, 600 bp, Homo sapiens
  misc_feature: GZ8MTXP01ES8SK.39.81.H04.1.454.CMB.2.raw
  modified_base (248)..(248): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaaacnctatgaatgttcagcagagcaggccaatctaccaagctacttaaatttataaggtttcaaccgggatcgtgggtcccagacagacttcagcggcaggtgggcaaggcaactgaattcaacactagaaaatcaggcgagggtaggaggacgtaggaggtagttgggtttaggggtttaattaacgtgacgtagttaggacgaaaggaaacacgacgtcggtacccgttaccgtaacgttacgttttacgggaccggtaaggggaacccgaaaggtccgttagggaaaggaacttaaccgaaaacggttaaccgttaagggtagggccttacggaccaacctaagttccgttcg

SEQ ID NO: 391140 - DNA, 600 bp, Homo sapiens
  misc_feature: GZ8MTXP01BA3CV.39.81.H04.1.454.CMB.2.raw
  modified_base (356)..(356): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaatggttcagcagaggccaggccaatctcaaggcacctaatttataaggtttcaaccgggctcgtgggtcccagacagacttcagcggcaggtgggtcnggcactgaattcacactagaaatcagcgagggtggaggacgtggaggtagttggttaggggtttaattacgttgacgtagtggacgaaaggaaacacgtaccgtagggaccctccgttaacctaccgttttcgggaccgtaacgggggaacccgaaggtaccgttagggtaacgaacgttaaccgaaaacggttaaccgttaagggtacggaaccgttacggacgaaccctaacgttccgttcg

SEQ ID NO: 391141 - DNA, 530 bp, Homo sapiens
  misc_feature: GZ8MTXP01EWK2V.39.81.H04.1.454.CMB.2.raw
  modified_base (365)..(365): a, c, t, g, unknown or other
  modified_base (386)..(386): a, c, t, g, unknown or other
  modified_base (433)..(433): a, c, t, g, unknown or other
  modified_base (499)..(499): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcagggcagngtcaccatcgaccacagacanatccacgagcacggcctacatcggacctgaggagcctagggagatcngacgacgacggcgtgtatacgtgtgcgaagagagtcggggaaattgtttgacgttggttacccctntttgaactacgtggggcctaaggggaactcg

SEQ ID NO: 391142 - DNA, 542 bp, Homo sapiens
  misc_feature: GZ8MTXP01EI8LD.39.81.H04.1.454.CMB.2.raw
  modified_base (284)..(284): a, c, t, g, unknown or other
  modified_base (342)..(342): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcagtctagtcaaagcctcgtatacattgatggaaacactatgaatggttcagcagaggcagcaatcacagcnctaatttataagtttcaaccgggatcgtgggtccagacagacttcagcgcagtgggcnggcactgaatcacatagaaaatcagcgagggtggaggacgtaggaaggtagttgggttaggggtttaattaacgtgacgaagtggaacaaagggaaacacgacgtcggacctccgtaactacgtttcggccgaaggggaccaaagcgttaggaagaacttacgaaacgaacgtggtacgcgtcgacactaacgttcttcg

SEQ ID NO: 391143 - DNA, 520 bp, Homo sapiens
  misc_feature: GZ8MTXP01C7BO5.39.81.H04.1.454.CMB.2.raw
  modified_base (315)..(315): a, c, t, g, unknown or other
  modified_base (502)..(502): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggtcagcagagccaggccaatctcaagcgctaatttataagttctaacggactcgnggggtcccagacagattccgagcggcagtgggtacaggcactgaattcacactagaaatcagcgagggtggaggcgtaggaggtagtggttagggtttattacgtgcagtgacgaaagaacacacgtggcctccgtactactttggccgagggaaccaagcgtaggagagtacaaacgacttgtggntcgcaccatcgttgttcc

SEQ ID NO: 391144 - DNA, 554 bp, Homo sapiens
  misc_feature: GZ8MTXP01CDGD5.39.81.H04.1.454.CMB.2.raw
  modified_base (345)..(345): a, c, t, g, unknown or other
  modified_base (369)..(369): a, c, t, g, unknown or other
  modified_base (513)..(513): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatggggatggatcagcgcttacaatggtcacacaaactntgaccacagaacctccagggcagngtcaccatcgaccacagacacatccacgagcacggacctacatcgacctgaggagcctagggacgtatcgtagacgaccgacggccgtagtattactgtgcggaagagagtacggggaaattagtttgaacgttggttaccctntttgaacttacgtgggggacctaacggggttaacccgtggg

SEQ ID NO: 391145 - DNA, 531 bp, Homo sapiens
  misc_feature: GZ8MTXP01BVNIA.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaatttataaggtttctaaccgggactcgtggggtcccagacagattccagcggcagtgggtcagggcactgaattcacactagaaatcagcgagggtggaggcgtaggaggtagtggttggggtttattacgtgcagtgacgaaaggaacacacgtcgcctaccgtactaccgttttggccgaggggaaccaaggcgtaggagatacgaaacgacttgtgctgcacatcttgttc

SEQ ID NO: 391146 - DNA, 538 bp, Homo sapiens
  misc_feature: GZ8MTXP01DK24Z.39.81.H04.1.454.CMB.2.raw
  modified_base (504)..(504): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcttcagtgaaggtctcctgcaaggcttctggttacacctttaccaactatggtatcagttgggtgcgacaggcccctggacaagggcttgagtggatgggatggatcagcgctttacaatggtcacacaaactatgccacagaacccttcaggggacagaagtcaaccatgaccacagacacatccacgagcacggcctacatggacctgaggagcctggagatctagacgacgacggccgtgtattactgtgcgaagagagtacggggaaatagtttgacgttggttaccctnttgaactcgtcggggcctaacgggaacccgtcgg

SEQ ID NO: 391147 - DNA, 545 bp, Homo sapiens
  misc_feature: GZ8MTXP01CQX76.39.81.H04.1.454.CMB.2.raw
  modified_base (247)..(247): a, c, t, g, unknown or other
  modified_base (280)..(280): a, c, t, g, unknown or other
  modified_base (302)..(302): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaacnctatgattgtcagcagagcagccaatctcagcnctattatagttcacggactcgngggtccagacagattccgaggcggcaggtgggtacaggcacgtgaacttcacactagaaaactcagcgaggggtggaggcgtaggtaagggtagttagggtttaggggtttattacgtgctaggtgacgaaaggaacacgacgtcggaccttaccgtactccgtttggaccgtagggggaaccaaggcgtagggagtacgtacgaaacgttcttggtaacgctcggctacactcgttcgttcc

SEQ ID NO: 391148 - DNA, 636 bp, Homo sapiens
  misc_feature: GZ8MTXP01BNWB6.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaaatctaccaaggccgtaccttaaatttataaaggtttccaaaccgggctcgtggggtacccagacagattcagcggcaaggtgggtcagggcactgaattcaacactagaaaatcagcgagggtggaggcgtagagggtagttgggttagggtttaattacgtagggacgtagtacggacgaaaagggaaccaacgtaccgttacggggaccccttacccggttaaccgttaccgttttcggggaaccccgtaaaggggggaccctaaagggccgttaaagggaacgaaagttccgaaaaacggtaaccgttgggtaaggtcgtacggaccgtaacccgttaagtttcccg

SEQ ID NO: 391149 - DNA, 578 bp, Homo sapiens
  misc_feature: GZ8MTXP01C6ERN.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactactgaatgttcagcagagccagccaatctccaagcgactaatttataaggtttctaacgggactcgtgggtcccagacagacttcagcgcagtgggtcaaggcactgaatcaacactagaaaatcagcgaagggtgaagggcgtaggaggtagttagggttacgggtttaattacgtagacgtagtagaacgaaacggaaacgaacgtacgtacgtaccgtaccgtaccgttacgtttacggtaccggaacgggaacgaacgacgttacggaacgtaacgttaacgaaacgaacgtaagtacgtcgtcgacgacctaacgttcgtcg

SEQ ID NO: 391150 - DNA, 557 bp, Homo sapiens
  misc_feature: GZ8MTXP01ALKUP.39.81.H04.1.454.CMB.2.raw
  modified_base (368)..(368): a, c, t, g, unknown or other
  modified_base (383)..(383): a, c, t, g, unknown or other
  modified_base (514)..(514): a, c, t, g, unknown or other
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaaggggcttgagtggatgggatggatcagcgcttacaatggtacacacaaactatgccacagaacctccgaggcagngtcaccatcgaccanagacacatccacgagcacggacctacagtcggacctgacggagcctagggagtacgtctagacgacgacggccgtagtattactgtcgcgaagagagtagggggaaattagtttgacgttggttacccctntttcgaacttacgtcggggaccgtaacgggttaacccgtcggg

SEQ ID NO: 391151 - DNA, 511 bp, Homo sapiens
  misc_feature: GZ8MTXP01BHIW4.39.81.H04.1.454.CMB.2.raw
  modified_base (302)..(302): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaatggttcagcagaggccaggccaatctccaaggcgcctaatttanaaggtttcaaccgggactctggggtcccagacagacttcagcggcagtgggcaaggcactgaaattcacactagaaatcagcagggtgaggctgaggatgttggggtttatacgtgcatgcaaggaacacgacgtggcctccgtacacgtttcggccgaaggggaccaagcttggagattacgaagaactgtggctgcaccaattcgtg

SEQ ID NO: 391152 - DNA, 575 bp, Homo sapiens
  misc_feature: GZ8MTXP01CCIYE.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaaggcacctaaatttataaggtttctaaccgggactcgtggggtcccagacagattccgagcggcagtggtcaggcactgaattcacactagaaaatcagcgagggtggaggcgtaggaggtagtggttaggggttattacgtgcaggtgacgaaaggaacacacgtcggccttaccgtactacgtttaggaccgaagggggaaccaaaggcgtaggagtaacgtacgaaaaccggttaacgttggtaagggcttcggaccacccgttaattccgttcgtttcccg

SEQ ID NO: 391153 - DNA, 565 bp, Homo sapiens
  misc_feature: GZ8MTXP01CFYMC.39.81.H04.1.454.CMB.2.raw
  modified_base (342)..(342): a, c, t, g, unknown or other
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggcacacaaactntgccacagaacctccgagggcagngtcaaccatcgaccacagacacatccacgagcacggcctaacatggaacctgaggagcctggagtatcagacgacgacggccgtgtacttacgtgtgcgtaagaaggttagtacgggggttaaattagttttcgacgttcggttaacccttcgtttagaacgttacggtcgggggaccctaacggggaaccccgttggg

SEQ ID NO: 391154 - DNA, 599 bp, Homo sapiens
  misc_feature: GZ8MTXP01DQY1J.39.81.H04.1.454.CMB.2.raw
  modified_base (448)..(448): a, c, t, g, unknown or other
  modified_base (504)..(504): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctttaacaatggtacacaacaaaactatgacccaacagaaaccctccgaaggggaccaagaagtcaaccatcgaacccacaagaacacatacccaacgacgcaaccggacctaacatcgggaacccnggaacggacgcccgtagggagtaatctaggaccgacgacggccgttagtattacgngtgcggaagagagtacggggaaaattagttttgacgttcggttaacccttgtttagaacgttacgtggggacctaacggggttaacccgttcggg

SEQ ID NO: 391155 - DNA, 678 bp, Homo sapiens
  misc_feature: GZ8MTXP01DTLR0.39.81.H04.1.454.CMB.2.raw
  modified_base (364)..(364): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgtaggttgggtgcgacgacggcccctggacgaagggtcttggaggtggagtgggatggatcgagcgtactttaacaagtggtacaacaacaaaactntcgaccacaagaaccctcgagggaacaagcgtcaaccatacgaaccacacgacacatacccgaacgacgaccgtaaccggaccttaacgaacgttcggaacccgttagggaacggaacgcccgttaaggggacgtacgtaccgtacggaaccggaaccgaccgggtaccgtttaggttaacttaaccgtgggtacggacggaaaggtaggttaacggtaacggggttaaatttagttttcggaaccgttcgggttaaccccttgttacgaacgttacgggtcggggacccgtaacggggttaaccccgttcggg

SEQ ID NO: 391156 - DNA, 623 bp, Homo sapiens
  misc_feature: GZ8MTXP01DCYG8.39.81.H04.1.454.CMB.2.raw
  modified_base (285)..(285): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctattgaattggttcagcagagccagccaatcncaagcactaattatagtttcaacggctcgtcgggtccagacagattcgagcggcaaggtgggtcaggcaacgtagaacttcaacactagaaatcaagcgaggggtaggaggcgtaggagggtagttagggttaggggtttaattacgttaggggtactaagttacgaacgtaaacggaaacaacgtacgtaccggtacccttacccggttaaccgtaccgttttacgggaacccggtaaacgggggaacccgtaaaggaccggttagggaacggttaacgttaaccgaaaacggtaacgtacggtcgggaccgtacggacctaaccgttaacgttccg

SEQ ID NO: 391157 - DNA, 551 bp, Homo sapiens
  misc_feature: GZ8MTXP01C7WR6.39.81.H04.1.454.CMB.2.raw
  modified_base (354)..(354): a, c, t, g, unknown or other
  modified_base (394)..(394): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacactacttgaatggttcagcagagccaggccaatctccaagcgactaatttataaggtttctaaaccgggctcgtgggtaccagacagacttcagcggcagtgggtcnggcactgaattcaacactagaaatcagacgagggtgaggngtagagtagttggttaggttattagtagagtagtagacgaacgaacacgacgtcgtacctcgtacgtacgttcggaccgaacgggaacgaggtcgttaggaagtaacgttaacgaaacgacgtggtacgtcgtacgaccttaccgtaacgttcgtcg

SEQ ID NO: 391158 - DNA, 542 bp, Homo sapiens
  misc_feature: GZ8MTXP01B2QBZ.39.81.H04.1.454.CMB.2.raw
  modified_base (250)..(250): a, c, t, g, unknown or other
  modified_base (282)..(282): a, c, t, g, unknown or other
  modified_base (310)..(310): a, c, t, g, unknown or other
  modified_base (418)..(418): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctcctgcaggtctagtcaaagcctgtatacattgatggaaacnctattgaattggttcagcagagccagcaatcncaagcactaattataaggtttcaacggntcgtgggtccagacagatcgagagcaagtgggcaggcactgaattcaacactagaaatcgagcgagggtggaggcgtagaggtagttggttagggtttattacgtggntagtgacgaaaggaacacgaacgtcggtacctccgtactaccgtttgggaaccgaacggggaccaaaggcgtaggagacgttacgaaacgtaacgtggtaacgctgactaaccgttaagttccg

SEQ ID NO: 391159 - DNA, 589 bp, Homo sapiens
  misc_feature: GZ8MTXP01BNTRG.39.81.H04.1.454.CMB.2.raw
  modified_base (551)..(551): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttaacaatggtacacaacaaaactatgcccacaagaaccctccgaggggaccagaacgtcaaccatcgaaccacagacacactccacgagcaacggaccctaacactacggaccctaggaacgggacgcccgtagggaacggtattccgtacggaaccgaccgaaccggccgttaggtacttacgtgtagcgaagagagtacgggaattagttgacgttcggttaccttnttagcgttacggtcgggaccgtaacgggaacccgtcgg

SEQ ID NO: 391160 - DNA, 578 bp, Homo sapiens
  misc_feature: GZ8MTXP01CTCGG.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctcctgcaggtctagtcaaagcctacgtatacattgataggaaacactattgaattggttcagcagagccaggccaatctacaaggcacttaaatttataacggtttctaaaccggcttcgtcggggtacccaggacagattacagcggctaaggttcgggtcagggcaacgtgaacttcaacactagaaaatcgagcgaggggtggaaggcgtaggaggtagttgggttgggttattaacgtggggactagtagagaaaggaacacgactacggcctaccgtactacgtttcggccgaaggggttaccaaaggcgtaggaacgaacgttacaaaacggtaactgtaaggctagactaaccgttaagtccg

SEQ ID NO: 391161 - DNA, 752 bp, Homo sapiens
  misc_feature: GZ8MTXP01D6PAF.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcagcgcttacaattggtacacaacaaactatcgaccacagaaccctccgaaggggaccaaggcgtcaacccatacgaacccacagaaccacactacccaacggacgaccgaaccggacccttaacgaagtcgggaaccctgggaacgggaacgtcccgtaggggaacgtaacgttccgtaacgggaacccggaaccgaacccggggtacccggtttaggtttaaacgtttaaccggtgggttacgggaccggaaagggtaagggttaaacggggttaaaccgggggttaaaaattttacggttttttaacgggttaacccggttttcccggggtttaaacccccttttcggtttttaaccgggtaacccgtttaacccggggttaccgggggggaaccccgttaaaccggggggttaaacccccgtttccggggg

SEQ ID NO: 391162 - DNA, 542 bp, Homo sapiens
  misc_feature: GZ8MTXP01D0J46.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctacaggtctagtcaaagcctcgtatacattgatggaaacacctacttgaatggttcagcagaggccaggccaatctccaaggcgaccttaaatttataaggtttctaaccgggactcgtggggtcccagacagacttcagcggcaggtgggcaagggcactgaattcacactagaaatcagcgagggtggaggcgtgaggtagttggttaggggtttattacgtgcgtagtgacaaggaacacgacgtggtacctccgtacgtacgtttcggccgtaagggaccagcgttggaagattacgaaacgacgtgtagctgcactaattcgtcg

SEQ ID NO: 391163 - DNA, 550 bp, Homo sapiens
  misc_feature: GZ8MTXP01BIA9Y.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagagccaggccaatctccaaggcgcctaaatttataaggtttctaaccgggactcgtgggggtcccagacagattccagcggcagtgggtcagggcactgaattcacactagaaaatcagcgagggtggaggcgtaggaggtagtggttaggggtttattacgtgcagtgacgaaaggaacaacacgtcggaccctaccgtactacgttttacggaccgaagggggaacccaaaggcgtaggagaatacgaaacgacttgtaaggctgcacatcttgttcc

SEQ ID NO: 391164 - DNA, 602 bp, Homo sapiens
  misc_feature: GZ8MTXP01B50EZ.39.81.H04.1.454.CMB.2.raw
  modified_base (344)..(344): a, c, t, g, unknown or other
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcgagcgcttacaatggtcacacaaactntgaccacagaacctccgaggcagngtcaacatcgaccacagacacatccaacgagaccacggacctacgatcggacctgaggacgcccgtagggacgtacgttcgtacgaaccgacgaacccgggtcgtacggttaacttaccgtgttggtggaagtaaggagtaacgggggttaaattagtttggaccgtttcgggttaccccttgtttacggtaaccttaccggtggggacccgtaacgggttaaccccgttcggg

SEQ ID NO: 391165 - DNA, 537 bp, Homo sapiens
  misc_feature: GZ8MTXP01C74WW.39.81.H04.1.454.CMB.2.raw
  modified_base (342)..(342): a, c, t, g, unknown or other
  modified_base (362)..(362): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtgcgacaggcccctggacaagggcttgagtggatgggatggatcagcgcttacaatggtcacacaaactntgccacagacctcaggcagngtcaccatgaccacagacacatccacgagcacggctacatggacctgagagcctgggagatctgacgacacggccgtgtatacgtgtgcgaagagagtacggggaaattagtttgacgttcgggttacccttcgtttgaaccgtacgtggggacctaaggggaaccccgttcggg

SEQ ID NO: 391166 - DNA, 503 bp, Homo sapiens
  misc_feature: GZ8MTXP01DI1DZ.39.81.H04.1.454.CMB.2.raw
  modified_base (499)..(499): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtcagcagaggccaggccaaatctccaaaggcgcctaatttataaggtttctaacgggactctggggtcccagacagattcagcggcagtgggtacaggcactgaattcacactgaaaatcagcagggtgaggctgaggatgtgggttatatgcagtgcaaggacacactggcctacgtactactttggcctaggggaaccaagctggagatcaaacgacttagtggctgcaccatcngttc

SEQ ID NO: 391167 - DNA, 553 bp, Homo sapiens
  misc_feature: GZ8MTXP01EO5WE.39.81.H04.1.454.CMB.2.raw
  modified_base (285)..(285): a, c, t, g, unknown or other
  modified_base (290)..(290): a, c, t, g, unknown or other
  modified_base (297)..(297): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagagccagcaatcncagcnctaattntaagtttcaacggctcgtgggtccagacagattcgagcggcaaggtcgggtcagggcacgtgaacttcacactagaaaatcgagcgagggtaggagggacgtaggagggtaagttgggtttaggggtttaattacgtagggactagtagacgaaaggaacacgacgtcggtacctccgtactacgtttcggccgtaacggggacaacggcgtaggagaagttacgaaacgaactggtcggctgactaacttcgttc

SEQ ID NO: 391168 - DNA, 578 bp, Homo sapiens
  misc_feature: GZ8MTXP01AFCVQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacacaaactatcgaccaacagaaccctccgaaggggaccaaggaacgtccaacccgatcgaacccacagaaccacatacccaacgacgcacgcctacatacggacctgaggacgccgtaggagatctacggacgacgacggccgtagtacttactgtgcgaagagagtacggggaaattagtttagacgttcggttaccctcgtttcgaaccgtacggtcgggaccgtaacgggaacccgtcggg

SEQ ID NO: 391169 - DNA, 568 bp, Homo sapiens
  misc_feature: GZ8MTXP01BQ9RQ.39.81.H04.1.454.CMB.2.raw
  modified_base (373)..(373): a, c, t, g, unknown or other
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacaacaaactatgccacagaaccctccagggaccaagngtcaaccatcgaaccanagacacatccacgagcacgcctacatcggacctgaggagcctagggagatctacgacgaccgacggtccgtagttattaacgtggtgcggaagagagtacggggaaattagtttggacgttggttacccctgtttcgaacgttacggtcggggaccgtaacggggttaacccgtcggg

SEQ ID NO: 391170 - DNA, 617 bp, Homo sapiens
  misc_feature: GZ8MTXP01D5PR3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcagcgtacttacgaattggtacaacacaaaactatgacccacagaaccctccgaagggcaagcgtaccaaccatcgaaccacagaccacactaccacgagccacggcctacatcggacctagaggacgccgtaggaacgtatccgtagaaccgacgtaccgggccgttagttacttacgtagtggacggaagaggttaggtacggggttaaattacgtttggacgttcgggttaccccttgtttacggaaccgtttaccgggtcggggttacccgtaaccggggttaaccccgttcgggg

SEQ ID NO: 391171 - DNA, 553 bp, Homo sapiens
  misc_feature: GZ8MTXP01BK10I.39.81.H04.1.454.CMB.2.raw
  modified_base (283)..(283): a, c, t, g, unknown or other
  modified_base (291)..(291): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactattgaattggtcagcagaggccaggccaatcnccaaggcncttaatttataagtttcaaccggctcgtgggtcccagacagattccaggcggcaggtgggtacaggcacgtgaaattcaacactagaaaatcagcgagggtggaggcgtaggaggtagttaggtttaggggttattacgtgcgtagtgtacgaaaggaacacgacgtcggccttaccgtactacgttttacggccgtaaggggaaccaagcgtaggaagaactacgaaacgacgttggtaagctcgacaccatcgttgttcc

SEQ ID NO: 391172 - DNA, 581 bp, Homo sapiens
  misc_feature: GZ8MTXP01A7KGU.39.81.H04.1.454.CMB.2.raw
  modified_base (244)..(244): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctcctgcccgtcaccttggacagccgctcatctcctgcaggtctagtcaaagcctcgtatacattgatggaaacnctattgaattggtcagcagagccaggccaatctaccaaggcgaccttaatttagtaaggtttctaaccgggactcgtcggggtccagacagattcagcggcagtggtacaggcactgaattcacactagaaatcagcgagggtggagcgtaggaggtagttgggttaggggtttattaacgtgtacgagttgacgtaaggaacaacgacgtcggaccttaccgtactacgttttcggaccgtaacggggtaaccaacggcgtagggaagtaacgtaaccgttaaaacgaacgttggtaacgggacttaacgaccgaccttactcttaaggtttcccg

SEQ ID NO: 391173 - DNA, 589 bp, Homo sapiens
  misc_feature: GZ8MTXP01DZIAY.39.81.H04.1.454.CMB.2.raw
  modified_base (344)..(344): a, c, t, g, unknown or other
  modified_base (369)..(369): a, c, t, g, unknown or other
  modified_base (384)..(384): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcagcgcttacaatggtcacacaaactntgccacagaaccctcgagggacagngtcaccatcgaccanagacacatccacgagccacggacctacatcggacctgaacgggacgcccgtaggggaacgtatccgtacggaaccgaaccgaccgggcccgttaggtacttacgtggtcgcggaaggagaggtacggggaaattgttttagacgttcggttacccttgtttacgaacgttacggtcgggggaccctaacggggaacccgttcggg

SEQ ID NO: 391174 - DNA, 647 bp, Homo sapiens
  misc_feature: GZ8MTXP01C9BQI.39.81.H04.1.454.CMB.2.raw
  modified_base (433)..(433): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctacaggtctagtacaaagcctcgtatacattgataggaaacactattagaatggttcagcagaggccaggccaatcctacgaaggcgtaccttaaattttagtaaacggtttcctaaaccgggtactcgtacgggggtacccaggacagtacttcgagcggcaggtgggtacaaggcaactgaaacttcaacgactaagaaatcagacgagggtggaggngtaggaggtagttaggttaggggtttaattacgtaggtacgtaagttagaacgaaacgggaaacaacgtacgtacgggtaccctacccgttaacgttaccgttttacgggacccggtaacggggaacccgaaggtacgttagggaaagtaacgttaacgaaaacggttaaccgttggtacggtaactcggaccttacctaacgttcgttaaccg

SEQ ID NO: 391175 - DNA, 649 bp, Homo sapiens
  misc_feature: GZ8MTXP01CWUOU.39.81.H04.1.454.CMB.2.raw
  modified_base (419)..(419): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaatatggtatcaggttgggtgcgacaggcccctggacaagggcttggagtggagtgggatggatcgagcgtacttaacaagttggacaacaacaaaactatcgaccaacgaagaaccctccgaggggaaccaagcgtcaaaccatacgaaccaacagaccacanccgaacgacgaccaacggacctaacagtacgggacctaggaacggacgcccgtagggaacgtaagttccagggaaccgacgaaccgggtccgttaggttacttaaccgtggtacggacggaaggaacggttaaggtaccggggttaaaattttacgtttacgttacgttcggttaccccttgtttacgtaaccgttacggtcggggaccgtaacggggaacccgttcggg

SEQ ID NO: 391176 - DNA, 598 bp, Homo sapiens
  misc_feature: GZ8MTXP01BVXSO.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaaatctccaaggcgaccttaaatttataaggtttctaaaccgggctcgtggggtcccagacagattcagcggcaagtgggtcagggcactgaattcaacactagaaatcagcgagggtggaggctaggaggagttggttaggggtttattacgtggctagttgacgaaaggaacacaacgtcggccctccgtaactacgttttcgggaaccgaacggggttacccaaaggccgttagggaacgttaacgttaccgaaaacggtaaaccgttggttaacgggaccgttacgggaccctaacccttaacgtttcccg

SEQ ID NO: 391177 - DNA, 590 bp, Homo sapiens
  misc_feature: GZ8MTXP01AHF60.39.81.H04.1.454.CMB.2.raw
  modified_base (369)..(369): a, c, t, g, unknown or other
  modified_base (480)..(480): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaactatgccacagaaccctccgagggcagngtcaaccatcgaccacagacacactccaacgacgccacggacctacagtcgggaacctggaggacgcctaggggagtaactcgacgacgacgacggccgtagtacttacgngtcgcgaagacgagtacggggttaaattacgtttggacgttcgggttaccccttgtttacggtaaccgttacgggtcgggggaccctaacgggggttaaccccgttcggg

SEQ ID NO: 391178 - DNA, 550 bp, Homo sapiens
  misc_feature: GZ8MTXP01AMPAM.39.81.H04.1.454.CMB.2.raw
  modified_base (358)..(358): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacactactgaatggttcagcagaggccaggccaatctccaaggcgacctaatttataaggtttctaaccgggctcgtggggtcccagacagacttcagcggcaggtgggtcnggcactgaattcacactagaaatcagcgagggtggaggcgtaggaggtagttggtttaggggtttaattacgtgacgtagtgacgaaaggaacacgacgtcggccctccgtactacgtttcggccgtaaggggaccaaggcgttaggaagattacgaaacgttacgtggtaggctcgcaccgtaattcgtcg

SEQ ID NO: 391179 - DNA, 565 bp, Homo sapiens
  misc_feature: GZ8MTXP01CJDNA.39.81.H04.1.454.CMB.2.raw
  modified_base (285)..(285): a, c, t, g, unknown or other
  modified_base (291)..(291): a, c, t, g, unknown or other
  modified_base (314)..(314): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacactacttgaattggttcagcagaggccagccaatcncaagcnctaattataagtttctaaccggntcgtgggtcccagacagattccgagcggcaggtgggtacaggcactagaattcacactagaaaatcagcgaggggtggaggcgtagaggtagttggtttaggggtttattacgtgacgagtgacgaaacggaacacgacgtcgcctacgtactacgtttcggccgtaaggggaaccaaaggcgtaggacgtaacgtacgaaaacgacgttggtaacggtcgtcgacctaccgttacttcgttaacgttccc

SEQ ID NO: 391180 - DNA, 553 bp, Homo sapiens
  misc_feature: GZ8MTXP01DFKRD.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaaatctaccaaggcgaccttaaatttataaggttttcctaaaccggggactcgtgggggtacccagacagattcagcggcaagtgggtcaggcactgaattcacactagaaatcagcgagggtggaggcgtaggaggtagttaggttaggggtttattacgtggcagtgacgaaggaacacgacgtcggcctccgtactacgttttggaaccgaggggaccaagcgtaggagacttacgaaacgaactgtggctgacaaccgaagttcg

SEQ ID NO: 391181 - DNA, 567 bp, Homo sapiens
  misc_feature: GZ8MTXP01AEOGH.39.81.H04.1.454.CMB.2.raw
  modified_base (252)..(252): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctacttgaattggttcagcagaggccaggccaaatctccaaggcgaccttaaatttataaggtttctaaaccgggtacttcgtgggggtcccagacagattcgagcggcaaggtgggtcagggcactgaattcacactagaaaatcagcgagggtggaggctagaggtatggtttggggtttattacgtggcagtgacgaaaggaacacgacgtcggcccttccgtactacgtttggccgtaagggggaccgaaggcgtagggaacgagttacgaaaacgtaactggtcggcgtcgacctaaccgttaattccg

SEQ ID NO: 391182 - DNA, 662 bp, Homo sapiens
  misc_feature: GZ8MTXP01CSACK.39.81.H04.1.454.CMB.2.raw
  modified_base (285)..(285): a, c, t, g, unknown or other
  modified_base (312)..(312): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccaggtggggatgttgtgatgactcagtctccagtcctccctgcccgtcacccttggacagccgcctccatctcctgcaggtctagtacaaagcctacgtatacattgatacggaaacacctatgaattggtcagcagagcagccaatcncaggcactaattataagttcaaccggntcgcgggtccagacagtattccgaggcggcaggtcgggtaacagggctacgtagaaactttcgaactaactagaaaactcaagacgaggggtggaggcgtaggaggtagttagggtttaggggtttaattacgtaggtactaggttacggaacgaaaggaaccgtaacgtaccgttaccgggtacccttaacccggttaaccgttaccggttttaccgggacccgggtaaacgggggtaacccgaaagggttccggttaaagggaacgtaaacgttaaccgaaaacggttaacgttagggttaacgggaccttaacggacctaaccgttaacgtttccgttcggtttccc

SEQ ID NO: 391183 - DNA, 634 bp, Homo sapiens
  misc_feature: GZ8MTXP01B41LL.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtccaggatccagtggggatgttgtgatgactcagtctcagtctcctgcccgtcaccttggacagccgcctcatctcctgcaggtctagtcaaagcctgtatacattgatagaaacactattgaattggtcagcagacgcagacatctacagctactaatttagtaagttcgaacggtctcgtcgggtaccagacagtacttccgacggcggtcgtagggtcggggtaacgaagggtccaaacgttacggtaaacttaccgaactaaacgtaaagaaaaactccgaaggacggtaagggggtagggaagggtcgtagggagggttagttaggggtttagggtttaactacgtgacgtaggtaggaacgaaacggaacaaccgtacgtacggtacccttaccggtacttacgtttacgggaccgaacgggtaaccaaggttcgtaggaagtaacgtaacgaaacgttacgttggtaacgcgtaacgacctacgttactccgttaagttcc

SEQ ID NO: 391184 - DNA, 573 bp, Homo sapiens
  misc_feature: GZ8MTXP01BPS6W.39.81.H04.1.454.CMB.2.raw
  modified_base (366)..(366): a, c, t, g, unknown or other
  modified_base (381)..(381): a, c, t, g, unknown or other
  modified_base (521)..(521): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaatggtcacacaaactatgccacagaacctcagggcagngtcaccatcgaccanagacacatccaacgagcacggacctacgatcgggacctgaggagcctgggagatctaggaccgacgacggccgttagtacttacgtgtgcggaaggagagtcgggggttaaattagtttggacgttcgggttaccccttnttttaggaaccgttacggtcgggggccccgtaaggggttaaccccgttcggg

SEQ ID NO: 391185 - DNA, 668 bp, Homo sapiens
  misc_feature: GZ8MTXP01A5S0R.39.81.H04.1.454.CMB.2.raw
  modified_base (354)..(354): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacgacggcccctggacaagggcttggagtggagtgggatggatcagcgacttacaagttggtacaacaacaaactntacgacccaacagaaccctccgaagggacaagcgtacaaccagtacgaaccacagaccacactacccaacgacgccacggaccctacagtcggaccctggaacggacgcccgtagggacgtacgttccgacggaaccggaccgaccgggtccgttagttaacgttacgtggtcgacggaaggtacggaaagggttacggggttaaaatttacggttttacggaccgtttccgggttaacccctttggtttacggtaaccgtttaacggggtccggggggttacccgtaaccgggggttaaccccgtttccgggg

SEQ ID NO: 391186 - DNA, 550 bp, Homo sapiens
  misc_feature: GZ8MTXP01DP3Z1.39.81.H04.1.454.CMB.2.raw
  modified_base (367)..(367): a, c, t, g, unknown or other
  modified_base (506)..(506): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgaccacagaacctcaagggcagngtcaccatcgaccacagacacatccacgagcacggacctacatggacctagaggagcctggagatctgacgacacggccgtagtattactgtgcggaagagagtacggggaaattagttttgacgttggttaccccttntttaggaacttacgtcggggacctaacggggttaaccccgttgg

SEQ ID NO: 391187 - DNA, 657 bp, Homo sapiens
  misc_feature: GZ8MTXP01BDT1O.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcgtagttgggtgcgacacggcccctggacgaagggcttgagtggatgggatggatcagcgtcttacaagtggtacacaacaaactatgaccacagaaccctccgagggacagaagtcaaccatcgaacccaacacgaaccacactacccgaacgacgaccaaccggccctaaacgacgttacgggaacctagggaacggacgtcccgtaggggacgtaacgttccgacggaacccgaaccgaccggtaccgttagttaacttacgtggtgaacggaaggaaggaaggttacggggttaaatttaggtttacgttaccgttcgggttaccccttcgtttaggaacccgttacgggtaccggggacccggtaaccgggttaaccccgttcggg

SEQ ID NO: 391188 - DNA, 522 bp, Homo sapiens
  misc_feature: GZ8MTXP01D9V9Q.39.81.H04.1.454.CMB.2.raw
  modified_base (356)..(356): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaatggttcagcagaggccaggccaatctccaaggcgcctaatttataaggtttctaaccgggatctggggtcccagacagacttcagcgcagtgggtcnggcactgaaattcacactgaaatcagcgaggtgaggctgagagtgttgggttatactgcgatgacaaggaacacacgtggacctccgtactacgttttggccgtaaggggcccaaggccgttgggaagaattacgaaacgactgtaggctgcacctaattcgttcg

SEQ ID NO: 391189 - DNA, 539 bp, Homo sapiens
  misc_feature: GZ8MTXP01BYH6H.39.81.H04.1.454.CMB.2.raw
  modified_base (358)..(358): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaatggttcagcagaggccaggccaatctccaaggcgcctaatttataaggtttcaaccgggactcgtggggtcccagacagacttcagcggcagtgggtcnggcactgaattcacactagaaaatcagcgagggtggaggacgtggaggtagttggttaggggtttattacgtgcgtagtggacaaagggaacacgacgtcggacctccgtactacgtttcggccgaaggggtaccaaggcgttggagattacgaaacgactggtgctgcacctaattcgtg

SEQ ID NO: 391190 - DNA, 651 bp, Homo sapiens
  misc_feature: GZ8MTXP01B88NT.39.81.H04.1.454.CMB.2.raw
  modified_base (391)..(391): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctcatctcctgcaggtctagtcaaagcctagtatacattgataggaaacactactgaatggttacagcagacggccaggaccaatcctaccgaaaggccgtaccttaaagttttaacgtaaacgggtttcctaaacccggggtacttcggtacggggtacccagacagtacttcgagcggacaggtgggtacnggcacgtagaacttcaactactaagaaaatcgagacgagggtggaggcgtaggaggtagttaggttaggggtttaattagtgacgtaagttaggaacgaaacggaaacaccgtacgtacggtacccgttaccgtaacgttacgttttcgggaccgtaacgggggaacccaaggtccgttaggaaagtaacgttaaccgaaaacggttaacgttcggtacggtccgttacggacccttaaccgtaactttccgtttaaccg

SEQ ID NO: 391191 - DNA, 606 bp, Homo sapiens
  misc_feature: GZ8MTXP01DDMPV.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattaaatggaaacactacttgaattggttcagcagaggccaggccaatctaccaaaggcgacctaaatttataaggtttactaaccgggacttcgtggggtcccagacagattcgacgcggcagtgggtcaagggcaactgaaattcaacactaggaaaatcagacgaggggtggaggcgtaggaggtagttggttaggggtttattacgtgcaagtggacgaaaggaaacaacgaactcggcccttaccgttaacgtacgttttacgggaccgtaacggggaaccaaaggccgttagggaacgaagtaaaccgaaaacgaacgttaggttcgggaacttacggaaccgtaccagttcctcgttctttaacc

SEQ ID NO: 391192 - DNA, 631 bp, Homo sapiens
  misc_feature: GZ8MTXP01BNZO3.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgccccgtcacccttggacagcccggcctccatcctcctgcaggtctagtcaaagcctcgtatacattgatggaaacacctattgaattggttcagcagacggccaggccaaatctccaaggccgtaccttaaatttagtaaggtttcctaaccgggactcgtcgggggtacccagacagtacttacgagcggcaagggtgggtcagggcacgtagaaacttcacactagaaatcgagcgaagggtggaggcgtaggagggtagttgggtttaggggtttattacgtggtacgtagtagaacgaaaggaaccaacgtaccgtacggtcccttaccgtacgttaccgttttcgggaacccggtaagggggttacccaaaggttcgtagggaacgttaacgttacgaaaacggtaacgtaggtaacggtcgtacggacctaaccgttaacttccg

SEQ ID NO: 391193 - DNA, 655 bp, Homo sapiens
  misc_feature: GZ8MTXP01CE815.39.81.H04.1.454.CMB.2.raw
  modified_base (347)..(347): a, c, t, g, unknown or other
  modified_base (362)..(362): a, c, t, g, unknown or other
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggggcctcagtgaaggtctcctgcaaggcttctggttacacctttaccaactatggtatcagttgggtgcgacaggcccctggacaagggcttgagtggatgggatggatcagcgcttacaatggtacacacaaacgtancgaccacacgaaccncgaggacagtcgacaccatacgaaccacanacactacgaccaacgacgaccgaaccggtacctaacgacgtacgggaccgtaggaacgggacgtccgtaggggagtacgtacgtacggaccgaccgaccggtaccggttacgttacgttacgttaggtcggacggaaggtaaggttacggtaacggggttaaaggtttaacgtttacgttacggttccggttacccgtttaaccgtttacgttaacgttacggtaccggggttaccgggtaaccgggttaacccggtaaccgg

SEQ ID NO: 391194 - DNA, 540 bp, Homo sapiens
  misc_feature: GZ8MTXP01AEKCS.39.81.H04.1.454.CMB.2.raw
  modified_base (363)..(363): a, c, t, g, unknown or other
  modified_base (516)..(516): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaatggttcagcagaggccaggccaatctccaaggcgaccttaatttataaggtttcaaccgggactcgtggggtcccagacagtacttcaggcggcaggtgggtcnggcactgaattcacactagaaatcagcgaggggtggaggctggaggtagtggttggggtttattacgtgcgtatgacgaaaggaacacacgtggacctccgtactaccgtttggccgaaggggaccaaggcgttaggagattacgaaacgacnggtggcctgacacctaagttctcg

SEQ ID NO: 391195 - DNA, 589 bp, Homo sapiens
  misc_feature: GZ8MTXP01DP0EF.39.81.H04.1.454.CMB.2.raw
  modified_base (361)..(361): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctatgaatggttcagcagaggccaggccaatctaccaaggcgaccttaaatttataacggtttcaaccgggactcgtggggtcccagacagtacttcagcgcaggtgggtcngggcactagaacttcaacactaagaaatcagcgaggggtggaggacgtaggaggtagttgggttaggggtttaattacgttgacgtagttaggacgaaaggaacacgacgtacggacccttaccgtactacgtttcggccgtaagggggaccaaacggtcgttagggaacgtaacgttacgaaaacgttaacgtggtacggcttacggaccttacgtaacgttcttcg

SEQ ID NO: 391196 - DNA, 553 bp, Homo sapiens
  misc_feature: GZ8MTXP01DKFNG.39.81.H04.1.454.CMB.2.raw
  modified_base (347)..(347): a, c, t, g, unknown or other
  modified_base (373)..(373): a, c, t, g, unknown or other
  modified_base (515)..(515): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcgagcgacttacaattggtcacacaaactntgaccacagaaccctccgagggcagngtcaccgatcgaaccacagacacactccacgagcacggcctacatggacctgaggacgccgtggagatctgacgacgacggccgttagtattacgtgtgcgaagagagtacggggaaattagtttgacgttggttacccttntttagaacttacgtcggggacctaacgggaaccctcgg

SEQ ID NO: 391197 - DNA, 581 bp, Homo sapiens
  misc_feature: GZ8MTXP01CC4H1.39.81.H04.1.454.CMB.2.raw
  modified_base (348)..(348): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgcttacaagtggtacacaacaaactntgaccacagaaccctccagggacaagcgtcaaccatcgaccacagacacactccacgacgcacggacctacatcggacctgacgacgccgtggacgatcgtacgacgacgaccggccgtagtacttacgtgtcgcgaagagacgtaggggaaattagtttgaacgttcggttacccttgtttacggtaacgttaccggtcgggggacccgtaacggggttaaccccgttcggg

SEQ ID NO: 391198 - DNA, 799 bp, Homo sapiens
  misc_feature: GZ8MTXP01CRFCO.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcgagcgtacttaacgaaagttcggtaccaacaactaaaactagtacgaccccaacgaacgaaaccccgtccgaacggggacaaacggaacgtacccaaacccgaagtacggaaaccccaacgaaacgaaacccaacctaactaccccgaaacggacgacccgaacccgggtacccttaaacgaacgttaccggggaaccctagggaaacgggtaacggaccccgttagggggaaacgtaacgtttaccgacgggaaacccggaacccggtaaccgggtcccggtttagttaaacgttttaccggtgggttacgggaacggaaagggtaacgggttaacgggtttaaacgggggttaaaactttttaagttttacgggttaaccgtttaccgggtttaaccccgttttaacgtttaacggtaacccgtttaaccgggtccgggggttaaccccgttaaccgggggttaaaccccgtttccgggg

SEQ ID NO: 391199 - DNA, 546 bp, Homo sapiens
  misc_feature: GZ8MTXP01EAQ8V.39.81.H04.1.454.CMB.2.raw
  modified_base (365)..(365): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactatgccacagaacctcagggcagngtcaccatcgaccacagacacatccagagcacggctacatggacctgaggagcctggagagtctgacgacgacggccgtagtacttactgtgcgaagagagtacggggaaattagtttgacgttcggttacccttgtttcgaacgttacgtcgggggacctaacggggaaccccgttcggg

SEQ ID NO: 391200 - DNA, 612 bp, Homo sapiens
  misc_feature: GZ8MTXP01BJIBL.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacactatgaattggttcagcagacggccaggccaatctaccaaggcgtacttaaatttagtaacggtttaccaaacgggtactcgttcgggggtcccaaggacaggtattacgaggcggcaagggtgggtcaggccatagtaaattcgaactaactagaaaatacgagacgagggtggaaggcgtaggaggtagttaggttaggggtttaattacgtgggactagtacgacgaaacggaacaacgtaccgtacggcccgttaccgttaacgtaccgtttcggaaccggtaaggggaacccgaaaggcgtaggaagacgttacgaaaacgaacgtaggtcgcgtacgacctaaccgttaacgtcg

SEQ ID NO: 391201 - DNA, 643 bp, Homo sapiens
  misc_feature: GZ8MTXP01DCGYF.39.81.H04.1.454.CMB.2.raw
  modified_base (282)..(282): a, c, t, g, unknown or other
  modified_base (359)..(359): a, c, t, g, unknown or other
  modified_base (544)..(544): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacaccttttacaactatggtatcgagttgggtgcgacncggcccctggacaagggctgagtggagtgggatggatcgagtcgacttaacgaagtggtacaacgaactaaaacgtntcgaccaacgacgaaccctcgaagggacaggaacgtcaaccagtacgaaccacgaacgacacgactcccgaacgacgaccgacggacccttaacgacgttacgggaacccttaggaacggacgtcccgttaggggaacgtaacgtccgtaaggaacccgtaacgacggtccgttagtacttacgngtacgcgaagagttaggtaacgggttaaattacgtttcgaacgttcggttacccttgttacgaacgttcggcgggacctaacgggttaacccgttcggg

SEQ ID NO: 391202 - DNA, 574 bp, Homo sapiens
  misc_feature: GZ8MTXP01DIS6S.39.81.H04.1.454.CMB.2.raw
  modified_base (416)..(416): a, c, t, g, unknown or other
  modified_base (478)..(478): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttaacaatcggtcaacaacaaaactatgacccaacagaaaccctcgaaggggacaagaacgtcaaaccatcgaaccacagacacataccacgancacggctacatcggactgaggacgcctaggagactcgagacgacgcggtcgtagtattacgngtcgcgtaagagaggtacgggaaatttagttacgacgttcggttacccttgtttagaaccgttacggtcggggacctaacggggaacccgttcggg

SEQ ID NO: 391203 - DNA, 620 bp, Homo sapiens
  misc_feature: GZ8MTXP01AS6RG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatggggatggatcgagcgacttacaagtggtacacaacaaactatcgaccacacgaaccctccgagggacagaacgtcaacccgatcgaaccacgaacgacacactaccaacgacgccgtaaccggaccctaacgacgtcgggaccctaggaacgggacgcccgtaggggacgtaacgttcgacggaaccgacgaccggtccgtagttaacttacgtggtgcggaagaggttacgtacggggaaattgtttacgacgttcggttacccttgttcgaacgtacggtcgggacccgtaagggttaaccccgttcgg

SEQ ID NO: 391204 - DNA, 610 bp, Homo sapiens
  misc_feature: GZ8MTXP01CLKCM.39.81.H04.1.454.CMB.2.raw
  modified_base (252)..(252): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctattgaattggttcagcagagccagccaatctcaaggcacctaatttataaggtttctaaccgggctcgtgggtacccagacagattcagcgcaagtgggtcagggcactagtaattccaactactagaaaatcaaggcgagggtggaggctaggtaggtagttggttaggggtttaattacgtgggtctagttgacgaaaggaaccacgaacgtcggtccctacccgttaacgttaccgttttcgggaacccgtaacgggggacccgtaaacggccgttagggaagttaacgttacccgaaaaacgtaacccggttggttaacggccgttacggaccgtaacccgttaagttccg

SEQ ID NO: 391205 - DNA, 544 bp, Homo sapiens
  misc_feature: GZ8MTXP01ELL5T.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaattggttcagcagaggccaggcccaaatctccaaggcgcctaaatttataaggtttcctaacgggacttcgtcggggtcccagacagattccagcggcagtggtacagggcactgaattcacactagaaaatcagcgagggtggaggcgtaggaggtagtggttagggttattactgtacagttgacgaaaggaacacacgtcggcctaccgtactacgttttcggaccgtaggggaaccaaagcgtaggagatacgaaacgacttgtgctgcaccagtcttgttcc

SEQ ID NO: 391206 - DNA, 557 bp, Homo sapiens
  misc_feature: GZ8MTXP01EAXJ4.39.81.H04.1.454.CMB.2.raw
  modified_base (249)..(249): a, c, t, g, unknown or other
  modified_base (346)..(346): a, c, t, g, unknown or other
  modified_base (356)..(356): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgccccgtcacccttggacagccgcctccatctcctgcaggtctagtcaaagcctcgtatacattgatggaaacnctattgaatggttcagcagaggccaggccaatctcaaggcgccttaatttataaggtttctaaccgggactcgtgggtcccagacagactcagcggnaggtgggtcngggcacgtgaattcacactagaaatcgagcgagggtggaggcgtagaggtagtggttaggggtttattacgtgcagtagacgaaaggaacacaacgtcggcccgtaccgtactacgttttcgggccgtaacggggacgaagcgttagggaagtaacgttaaccgaaaacgacgtggtacgcgtcgacacctaagttcttcg

SEQ ID NO: 391207 - DNA, 620 bp, Homo sapiens
  misc_feature: GZ8MTXP01EJLYK.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctcatctcctgcaggtctagtcaaagcctgtatacattgatggaaacactattgaattgttcagcagagccagccaatcacaagctactaatttataaggttcaacggctcgtcgggtaccagacagatcgagcggcaagggtgggtcaggcacgtagaacttcaactactagaaaatcgaaggcgaaggggtggaaggtcgtagggaagggtagttagggtttaggggtttaattacgtgggtacgtaagtacgaacgaaacgggaaccacgtacggtccggtacccttacccggttacgttacggttttcgggaacccggtaacggggaaccaaaggttcgttaaggaacgttaaacttaccgaaaaaccggtaagtcggtaagggtacctacgaccctaaccgttaagttcccg

SEQ ID NO: 391208 - DNA, 613 bp, Homo sapiens
  misc_feature: GZ8MTXP01BQ2H3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacgaagggcttggagtggatgggatggatcgagcgtactttaacaagttggtaccaacaacaaaactatcgaccaacaagaaccctccgagggacaagcgtcaaccatcgaaccacagacacatccacgagcacgcctacatcggacctgacggacgccgtagggacgtaatcgtaggaaccgaaccgaccgggtaccgtagttacttacgtggtcgacggaaggaacggaaggtaacggggttaaattagttttggaccgttcggttaccccttgtttacgaaccgttaacggtcggggaccgtaacgggttaaccccgtggg

SEQ ID NO: 391209 - DNA, 521 bp, Homo sapiens
  misc_feature: GZ8MTXP01D6TJY.39.81.H04.1.454.CMB.2.raw
  modified_base (279)..(279): a, c, t, g, unknown or other
  modified_base (285)..(285): a, c, t, g, unknown or other
  modified_base (367)..(367): a, c, t, g, unknown or other
  modified_base (378)..(378): a, c, t, g, unknown or other
  modified_base (404)..(404): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattgtcagcagagcagcaatcncaagcnctaatttataagttctaacggactctgggtccagacagattccagcgcagtggtcaggcactgaaattcacactgaaatcancagggtgaggngtagagtagtggttaggttatagtgnagtagacgaaagaacacgacgtcgacctacgtacgtacgttacggaccgagggaacaagcgtaggagtaagtaacgaaacgaacgttacgtaaggtcgtcgacacgactcgttcgtc

SEQ ID NO: 391210 - DNA, 553 bp, Homo sapiens
  misc_feature: GZ8MTXP01DOBJI.39.81.H04.1.454.CMB.2.raw
  modified_base (366)..(366): a, c, t, g, unknown or other
  modified_base (419)..(419): a, c, t, g, unknown or other
  modified_base (430)..(430): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaatggtcacacaaactatgccacagaacctcagggcagngtcaccatgaccacagacacatccacgagcacggcctacatggacctgaggancctggagatcngacgacacggccgtagtattactgtgcgaagagagtcgggggaaattagttttgaacgttgggttaacccctgttttacgaacttaacgtgggggaccctaagggggttaaacccccgttggg

SEQ ID NO: 391211 - DNA, 590 bp, Homo sapiens
  misc_feature: GZ8MTXP01BP11Z.39.81.H04.1.454.CMB.2.raw
  modified_base (378)..(378): a, c, t, g, unknown or other
  modified_base (411)..(411): a, c, t, g, unknown or other
  modified_base (422)..(422): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatggatcgaggcgcttacaattggtacacaacaaactatcgaccacagaaccctccgaagggcagngtcaaccatcgaccacacgacacataccacgancacggacctanactcgggacctgaaggacgccgtaggagacttcgaggaccgaccgacgggtccgtagtattacgtgtcggcgtaagagaggtacggggttaaattgtttacgacgttcgggttaccccttgtttacgaaccgttacggtcggggacctaacggggttaacccgtccgg

SEQ ID NO: 391212 - DNA, 751 bp, Homo sapiens
  misc_feature: GZ8MTXP01DMV1A.39.81.H04.1.454.CMB.2.raw
  modified_base (358)..(358): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttaccaactatggtatctagttgggtgcgacgacggcccctggacaagggtcttggagtggatggggatggatcgagcgtacttacaagttggtacaacaactaaaactntacgaccaacgaacgaaccctccgaagggggaccaaggaacgtaccaaacccaagtacggaaaccccaacgaaacgaaccaaaccaactacccgaacggaacgacccgtaacccgggacccttaacgagttaccgggaacccgttagggaacgggaacgcccgtaggggaaacgtacgttaccgtacggaaccggaaccggaccgggtacccgtttaggttaacgtttaccgtggtacggaccgggtaaagggtaagggttacggttaaaccgggggttaaaatttttacgtttttacgggaaccggttttccgggtttaacccctttcgtttacggtaaccgtttaccgggtcgggggttacccgtaaccgggggttaaccccgtttcgggg

SEQ ID NO: 391213 - DNA, 555 bp, Homo sapiens
  misc_feature: GZ8MTXP01EHXN6.39.81.H04.1.454.CMB.2.raw
  modified_base (343)..(343): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacacaaactntgaccacagaacctccagggaccagcgtcaaccatcgaaccacagacacatccacgagcacggcctacatggacctgaggagcctaggagatctagacgacgacggccgtgtattacgtgtgcgaagagagtacggggaaattgtttagacgttcggttaaccccttgtttagaacttacggtcggggacctaacgggttaacccgttcggg

SEQ ID NO: 391214 - DNA, 680 bp, Homo sapiens
  misc_feature: GZ8MTXP01BIJW4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacaggcccctggacgaagggcttggaggtggagtgggatggatcgagcgtactttacgaatggtaccaacaacaaactatcgacccaacaacggaaccctccgaagggacaaggaacgtaccaaccatacgaacccaacagaccacactaccaacgacgacaaccggacctaacgagtcggaccgtagaacggacgcccgtagggaagtacgtccgtacggaaccgaaccgaccgggtaccgttaggttaacttaccggtggttacggacggaagggtaaggttaacgggttaaccgggggttaaaatttaggttttacgttaaccgttcggggttaccccctttgtttacggaacctttacgggaccgggggttacccgtaacggggttaaccccgttcggg

SEQ ID NO: 391215 - DNA, 542 bp, Homo sapiens
  misc_feature: GZ8MTXP01DBEGV.39.81.H04.1.454.CMB.2.raw
  modified_base (249)..(249): a, c, t, g, unknown or other
  modified_base (266)..(266): a, c, t, g, unknown or other
  modified_base (368)..(368): a, c, t, g, unknown or other
  modified_base (404)..(404): a, c, t, g, unknown or other
  modified_base (521)..(521): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacnctacttgaattggtaancagaggccaggccaatctccaaaggcgaccttaaatttataaggtttctaaccgggactcgtgggggtcccagacagattcagcggcagtgggtcaagggcnctgaattcacactagaaaatcagcgagggtggaggntgaggtagttggtttggggttattacgtgacagtggacaaggaacacgactcggccctccgtactacgttttcggaccgtaggggaccaagcgttggagagtacgaacgaacgttgnggctgcaccattctgttcttc

SEQ ID NO: 391216 - DNA, 532 bp, Homo sapiens
  misc_feature: GZ8MTXP01BAVOF.39.81.H04.1.454.CMB.2.raw
  modified_base (376)..(376): a, c, t, g, unknown or other
  modified_base (381)..(381): a, c, t, g, unknown or other
  modified_base (405)..(405): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacactactgaatggttcagcagaggccaggcaatctccaagcgccttaaatttagtaaggtttctaaccgggactcgtcggggtcccagacagtacttcagcgcaggtgggtcaaggcactgaattcganactanaaatcagcagggtgaggctgaggntggttgggttatacgtgacgtatgacgaaggaacacacgtgacccttcgtacctacgttttcggcgaacggggacaaggcgttaggacgtattacgaaacgacgtgtggctgcacctaattcgttcg

SEQ ID NO: 391217 - DNA, 553 bp, Homo sapiens
  misc_feature: GZ8MTXP01D8REX.39.81.H04.1.454.CMB.2.raw
  modified_base (387)..(387): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatggaaacactacttgaattggttcagcagaggccaggcccaatctacaaggcgaccttaaatttataaggtttcctaaaccgggactcgtcggggtcccagacagattcagcggcaaggtgggtcaggcaacgtgaattcanactagaaatcagcgagggtggaggctaggaggagttggttgggtttattacgtgggactagtgacaaacggaacacacgtcggcctaccgtactacgtttcggaaccgtacggggaccagcgtaggagaacgttacaaacgaactgtggctgactaacttaagttc

SEQ ID NO: 391218 - DNA, 691 bp, Homo sapiens
  misc_feature: GZ8MTXP01C0V2L.39.81.H04.1.454.CMB.2.raw
  modified_base (273)..(273): a, c, t, g, unknown or other
  modified_base (382)..(382): a, c, t, g, unknown or other
  modified_base (412)..(412): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggngcgacaggcccctggacaagggcttgagtgagtgggatggatcgagcgtcttaacaagttggtacaacaacaaactatcgaccaacaacgaaccctccgagggaacagngtaccaaccaatcgaaccacagaaccacanacccgaacgacgccaacggtcctaacagtacggaccaggaacggaacgccgtagggacgtaacgtcacggaaaccgaccgtaccgggtccgttaggttaactttaaccgggtcggtacggaacggtaaggtaaacggttaaacgggttaaacgggttaaagttttacgtttaacggttaacccggtttaccggtttaccccgttttaacggtttaaccggtaaccggtttaacggggtaccgggggttaccccggtaaccggggttaaccccgttcggg

SEQ ID NO: 391219 - DNA, 584 bp, Homo sapiens
  misc_feature: GZ8MTXP01EZ89K.39.81.H04.1.454.CMB.2.raw
  modified_base (337)..(337): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctcatctcctgcaggtctagtcaaagcctcgtatacattagataggaaactacctacttgaattggttcagcagagcagcaatcacagcactaattatagttcaacggctcgtcgggtaccagacagatcagcggnaagggtggtcagggcactgaacttcactaactagaaatgaggcgaggggtggaggtgtaggaggtagttgggtttagggtttaattacgtaggactagtacgaacgaaacggaaccacgacgtaccggtacccttaccgtaccgtacgttttcgggaacccggaacggggaaccctaaaggccgtagggaacgaagttacgaaaaccggtaagtggtaacgtcacggacctaacccgttaatttccg

SEQ ID NO: 391220 - DNA, 652 bp, Homo sapiens
  misc_feature: GZ8MTXP01BK3M2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttacaactatggtatcagttgggtgcgacacggcccctggacaagggcttgagtggagtgggatggatcaggcgcttacaagtggtacaacgaacaaactatcgaccacgaagaaccctccgaggggacaagcgtacaaccatacgaacccacgaaacgaccaacactacccgaacggacgacccgtaaccgggaccctaacgaacgttcgggaacccgttaggaacgggacgtcccgtaggggaacgtaacgtaccgtacggaaccgaaccgacgggtccgttagttattaccgtggtcgcggaagaggttaacggtaggggttaaatttagtttcgacgtttcggttaccctttgttacggaactacgggtgggacccgtaacgggttaacccgtcggg

SEQ ID NO: 391221 - DNA, 557 bp, Homo sapiens
  misc_feature: GZ8MTXP01AWAGT.39.81.H04.1.454.CMB.2.raw
  modified_base (344)..(344): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaatggtcacacaaactntgccacagaacctccagggcagngtcaccatgaccacagacacatccacgagccacggcctacagtcggacctgaggagccgtggagatctagacgacgacggccgtagtacttacgtgtgcgaagagagtacggggaaattagttttgacgttcgggttacccttgtttacgaacgttacgtcgggggaccctaacggggaacccgttcggg

SEQ ID NO: 391222 - DNA, 647 bp, Homo sapiens
  misc_feature: GZ8MTXP01EY0X5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcagcgcttacaatggtacaacaacaaactatcgaccaacacggaaaccctccgaaggggaccaagaacgtaccaacccatcgaacccaacgagaaccaacatacccaacgacgaccacgggaccctaacagtacgggacctagggaacgggacgcccgtaggggaacgtacgtaccgtacggaaaccgaccgaaccgggtcccggttagtaacttaccgtggtggacggaaggaagaggtacggggttaaattaggttttgacgttcgggttaaccctttgtttacgaacgttacggtcgggggacctaacggggttaaccccgttcggg

SEQ ID NO: 391223 - DNA, 638 bp, Homo sapiens
  misc_feature: GZ8MTXP01CBE0D.39.81.H04.1.454.CMB.2.raw
  modified_base (280)..(280): a, c, t, g, unknown or other
  modified_base (412)..(412): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttctggttaccacctttacaactatggtatcgtaggttgggncgacacggccctggacaagggcttgagtggatgggatggatcgagcgtacttacaagtggtaccaacaacaaaactgtcgaccaagacgaaaccctccgaaaggggcaagacgtacaacagtcgaacccaanacgaccaacacaccaacgacgaccaacgggacctaacgagtacggaccttggaacgtacgaccgtaggagacgtacgtacgaaccgaccgacgggtccgttagtaacgttacgtcggtggaacggaaggagggtacgttaacgggggtaaatttacggtttacgttcgttacgggttaacccttcgttaacgtcgtacggttcgggaaccgttaacgggtaacccg

SEQ ID NO: 391224 - DNA, 544 bp, Homo sapiens
  misc_feature: GZ8MTXP01BRBMY.39.81.H04.1.454.CMB.2.raw
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccccctggacaagggcttgagtggatgggatggatcagcgcttacaatggtcacacaaactatgccacagaacctccagggcagngtcaccatcgaccacagacacatccacgagcacggcctacatggacctgaggagcctgggagatctgacgacacggcccgtgtattacgtgtgcgaagagagtacgggggaaatagtttgacgttgggttaccccttctttcgaactacgtcggggaccgtaacgggaacccgtcggg

SEQ ID NO: 391225 - DNA, 597 bp, Homo sapiens
  misc_feature: GZ8MTXP01CDIHK.39.81.H04.1.454.CMB.2.raw
  modified_base (364)..(364): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaatggttcagcagaggccaggccaatctaccaaggcaccttaatttataaggtttctaaccgggactcgtcggggtacccagacagtactcgagcggcaggtgggtcnggcacgtgaattcaacactagaaatcgagacgagggtaggaggacgtaggaggtagttggttaggggtttattacgtgacgagttaggacgtaaagggaacaacgtacgtcggtacccttccggtacctaccgttttcgggcccgtaacgggggaaccaagggtcgttagggaacgtaacttaaccgaaacgaaccgttggtacggtctcgaccgacctaacgttcgttaacg

SEQ ID NO: 391226 - DNA, 545 bp, Homo sapiens
  misc_feature: GZ8MTXP01EBFPV.39.81.H04.1.454.CMB.2.raw
  modified_base (438)..(438): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatctaccaaggcgacctaatttataaaggtttctaaccgggacttacgtgggggtacccagtacagattccagcggcagtggtacaggcactgaacttcaacactgaaaatcagcagggtggaggcgtagaggatggttgggttatactgcagtganaaggacacactggcctaccgtactacgtttcggccgaacggggaacaagcgtaggaacgacgtaacgaaacgttacgttgtgggactgacaccgataacgttgttcc

SEQ ID NO: 391227 - DNA, 610 bp, Homo sapiens
  misc_feature: GZ8MTXP01BBRD6.39.81.H04.1.454.CMB.2.raw
  modified_base (346)..(346): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaagtggtacacaacaaactntgccacagaaccctcgaggggccagaacgtcaccatcgaaccacagacacactaccaacgacgccacggacctacactacggaccctaggaggacgcccgtagggacggactcgtacggaaccgacgaccgggtccgtagtacttacgtgtcgcggaaggtaggagtacgggggaaattagtttacgacgttcgggttaccccttcgtttacggtaaccgttacggtacgggggttaccggtaacggggttaaccccgtcgggg

SEQ ID NO: 391228 - DNA, 654 bp, Homo sapiens
  misc_feature: GZ8MTXP01C8XHH.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagcccggcctccatctcctgcaggtctagtacaaagcctcgtatacattgataggaaactactacttgaattggtcagcagagccaggccaatcctacgaaggctaccttaatttaagttaaggtttaccgtaaccggtacttcggtacggggtaccaagactagtacgttccgacggacggcgtaagggtcgggtaaccgaagggtccaacgtacgtaaacttacaacaacgtaaagaaaactcgaagacggtaaggggtggaggtacgtagggtaggtagtttgggttagggtttaattagtgtactagggtacgaacgaaacgtaacacgtacgtcggacccttacggtaccttacggtttacggacccgggtaagggaacccaaggttacgtaggaacgtaaacgtaccgaaaacgttcgttggtcggactggaccacttacttcttcgtttaaccc

SEQ ID NO: 391229 - DNA, 552 bp, Homo sapiens
  misc_feature: GZ8MTXP01D0G59.39.81.H04.1.454.CMB.2.raw
  modified_base (363)..(363): a, c, t, g, unknown or other
  modified_base (376)..(376): a, c, t, g, unknown or other
  modified_base (508)..(508): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcacacaaactatgccacagaacctcaggcagngtcacatgaccanagacacatccacgagcacggacctacatcggacctgacggagccgtaggagtatctagaccgacacgggcgtagtattactgtgcgaaggagagtacggggttaaattagttttgacgttcggttacccctntttacgaacgtacgtcgggggacctaacggggaacccgttcggg

SEQ ID NO: 391230 - DNA, 519 bp, Homo sapiens
  misc_feature: GZ8MTXP01CTJU3.39.81.H04.1.454.CMB.2.raw
  modified_base (347)..(347): a, c, t, g, unknown or other
  modified_base (496)..(496): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagctcgtatacattgatgaaacactactgaattggtcagcagagccaggccaatctccaaggcgacctaaatttactaaggtttctaaccgggacttcgtggggtcccagacagattccagcgnagtggtcaggcactgaaattcacactagaaatcagcgagggtggagcgtgaggtagtggttagggtttatacgtgcaggtgacaaaggacacacgtgcctacgtactactttcgccgagggaaccgaagcgtaggagatacaaacgacnggtaagctgcacatcgttgttcc

SEQ ID NO: 391231 - DNA, 627 bp, Homo sapiens
  misc_feature: GZ8MTXP01EIIAY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacacggcccctggacaagggcttggaggtggatgggatggatcgagcgtacttacaagtggtacacaacaaactatcgaccacagaaccctcgagggaccaagcgtcaaccatacgaccaacagacacatacccacgacgaccgacggaccctaacgagtacgggacctaggacggacgccgtaggggacgtacgttcgacggaaccggacgaccgggtaccgttagttacttacgtggtcggcggaaggaaggttaggtacgggggttaaatttgtttacgaccgtttcggttacccctttgttacgtaacgttacggtcggggaccgtaacgggttaacccgttcggg

SEQ ID NO: 391232 - DNA, 721 bp, Homo sapiens
  misc_feature: GZ8MTXP01CVBF7.39.81.H04.1.454.CMB.2.raw
  modified_base (595)..(595): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaaggtcttctgttactacctttacaactatggtatcgtaggttgggtgcgacgacggccccgtagggacgaagggtcttggaggtggagtgggatggatcgaggtcgtacttaacaagttcggaccaacaacctaaaacttagtacgaccccaaccgaaacgaaccctacccggaaggggaaccaacggtaacgtaccaaaccgtaacgtacgaaaccccaacaaacgaacccaacctacgtaaccccgaacggacgacccgaaccggaccttaaccgaagtccggacctagggacggacgtaccgtagggacggtattaccgacggaaccgtaccgaccggtacgttacgtaactttacgggnggtacgggacggtaaggtaggttaacgggttaacggttaaagttttacggtttacgttaccggttcgttacccgtttgttacggtaaccggtacggggtccgggaccggtaacgggttcccggtcg

SEQ ID NO: 391233 - DNA, 626 bp, Homo sapiens
  misc_feature: GZ8MTXP01DN4JK.39.81.H04.1.454.CMB.2.raw
  modified_base (321)..(321): a, c, t, g, unknown or other
  modified_base (331)..(331): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgataggaaacacctattgaattggtcagcagagcaggccaatcacagcactattatagttcacggactgtgggtccagacngattcagcgnagtgggtacaggcacgtgaaacttcaaactacgtagaaaactcgaagcgagggtggaggtagtaggaggtagttgggtttaggggtttaattacgtgtacgtaggttacggacgaaacggaacacgtaacgtccggaccgtttaccgttaccgttaacgttttcgggacccggtaacggggtaaacccaaggttaccgtagggaagtaaaccgttaacggaaaacccgttacggttagggtcgggttacccgtaaccgtaaccgtaaccgttacgtttccgtttaacgttaaccg

SEQ ID NO: 391234 - DNA, 681 bp, Homo sapiens
  misc_feature: GZ8MTXP01EMQPO.39.81.H04.1.454.CMB.2.raw
  modified_base (269)..(269): a, c, t, g, unknown or other
  modified_base (351)..(351): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctcctgcaggcttctgttacacttacatatggtatcgtaggttggtncgacacggcccctggacaagggtctgagtggagtgggatggatcgagcgtactttaacgaagtggtacaacaactaaaactntacgacccaacgaacgaaccctccgaaggggacaaggaacgtacaaaccgagtaccgaaccaacgacgaaccacaactacccgaacggacgacccgaaccgggtacccttaacgaacgttcgggaacccgtagggaaacggaacgtcccgtaggggaacgtacgtaccgtaacggaaccgaaccggaccggtaccggttagttaacttacgtggtacgacggtaaggaaggttagggtacgggttaaattcgtttggaacgttcgttacccctttgttacgtaaccgttcgggtaccgggggaccgtaaccggggttaacccgttccggg

SEQ ID NO: 391235 - DNA, 556 bp, Homo sapiens
  misc_feature: GZ8MTXP01D6H8P.39.81.H04.1.454.CMB.2.raw
  modified_base (344)..(344): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccgctccatctcctgcaggtctagtcaaagcctcgtatacattgatggaaacactatgaatgttcagcagagcagccaatctcaagcacctaatttataaggttcaaccgggatcgtgggtcccagacagacttcagcgcagtgggtcnggcatgaattcacactagaaatcgagacgagggtaggaggacgtggaggtagttaggttaggggtttattacgtgacgtagtggacaaacgggaacaacgacgtcggtccctaccgtactacgttttcggaccgtaaggggaaccaaggcgttagggaagtaacgttacgaaacgaacgtggtgcgttggaccttacctaacgttcttaacg

SEQ ID NO: 391236 - DNA, 551 bp, Homo sapiens
  misc_feature: GZ8MTXP01DXW1U.39.81.H04.1.454.CMB.2.raw
  modified_base (279)..(279): a, c, t, g, unknown or other
  modified_base (284)..(284): a, c, t, g, unknown or other
  modified_base (308)..(308): a, c, t, g, unknown or other
  modified_base (331)..(331): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctattgaattggtcagcagagcagcaatcncagcnctaattatagttctacggactcgngggtccagacagatccaggcggnaggtggtacaggcactgaattcacactagaaaactcagcgaggggtggaggcgtaggaggtagtgggtttaggggttatacgtgactaggtagacgaaaggaacacgacgtcggcccttacgtacttacgttttcggaccggacggggtaacaaggcgtacggaagtaacgttacgaaacggttacttaggtcggctcggcaccgttactcgttcgttcc

SEQ ID NO: 391237 - DNA, 601 bp, Homo sapiens
  misc_feature: GZ8MTXP01BMRQZ.39.81.H04.1.454.CMB.2.raw
  modified_base (345)..(345): a, c, t, g, unknown or other
  modified_base (384)..(384): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacaggcccctggacaagggctgagtggatgggatggatcgagcgcttacaatggtcacacaaactntgaccacagaacctcagggacagcgtcaccatcgaccanagacacataccacgagaccacggaccctacgagtcggaccgtgaacggacgacccgtaggggaacgagttccgacggaaccgaccgaccggccgttagttacttaccgtggtgcgaaggagaggtacggggttaaattaggtttagacgtttcgggttacccttaacgtttcgtaacgttacggtcggggacccgtaacgggttaaccccgttcggg

SEQ ID NO: 391238 - DNA, 704 bp, Homo sapiens
  misc_feature: GZ8MTXP01CK9L6.39.81.H04.1.454.CMB.2.raw
  modified_base (352)..(352): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctctgcaggtctagtcaaagcctacgtatacattagataggaaactacctacttagtaattggtcagcagagccaggccaatcacaagcacttaatttactaaggttctaaccggctcgtcggggtaccagacagattccgaggcggngtaggtggtacagggtccacgtagaaacttccaactaacgtaagaaaactcgaagacggaagggggtggaaggtacgtagggtaagggtagtttaggggtttacgggggtttaatttaccggtagtacgtaagggttacggaacggtaaaagggtaaacccgtaccgtaaccgttccggggtaccctttaaccccgggttaacgtttaaccggttttccgggaacccgggtaacgggggtaaccctaaagggttccggtaagggaacgtaaacgttaacccggaaaaacgttacggttacggttaacggccgttaacggacctaaccgttacttaaccggttcgtttaaccg

SEQ ID NO: 391239 - DNA, 713 bp, Homo sapiens
  misc_feature: GZ8MTXP01C4TEL.39.81.H04.1.454.CMB.2.raw
  modified_base (194)..(194): a, c, t, g, unknown or other
  modified_base (249)..(249): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacngccgcctccatctcctgcaggtctagtcaaagcctgtatacattgataggaaacnctattgaattggtcagcagaggccaggccaatctaccaaaggcgtaccttaaattttagtaacggttttactaaccggggtacttcgtcgggggttaccccaagaccgagtactttcccgaaggtcggactaagggtgggtaccgaagggtcaacgttaggaaactttccgaacctaactaaggaaaaaacttccgaagaccggtaagggggtgggacgggtacgtagggagggtaagtttgggtttagggggttttaattaacgttggtaccgtaaggttacggtaacgaaaagggtaaaccaacgtaaccgttcggtaccccgttaccgtaaccgttaacgttttccgggacccgtaaacgggggaacccaaaggttccgttaagggaagtaaacgtaacggaaaacgttaaccgttagggtcggaacttcggaccctacgttacgttcttaaccggtttcc

SEQ ID NO: 391240 - DNA, 560 bp, Homo sapiens
  misc_feature: GZ8MTXP01APHQ7.39.81.H04.1.454.CMB.2.raw
  modified_base (275)..(275): a, c, t, g, unknown or other
  modified_base (344)..(344): a, c, t, g, unknown or other
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtacacacaaactntcgccacagaaccctccgagggcagngtcaccatcgaccacagacacatccacgagcacgacctacatcggacctgaggacgcctgggacgatcgacgacgacgacggccgtagtacttacgtgtcgcggaagagagtacggggaaattagtttgacgttcggttacccttcgttgaacttacggtcggggaccgtaacggggttaacccgtcggg

SEQ ID NO: 391241 - DNA, 624 bp, Homo sapiens
  misc_feature: GZ8MTXP01BBM7K.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctgtatacattgatggaaacacctattgaattggttcagcaggacggccaggccaatctccaaggcaccttaaatttataaggtttcaaccgggactcgtcggggtcccagacagtacttcgagcggcaagtgggtcaggcatgaaattcactactagaaatcgagcgagggtggaggcgtaggaggtagttggtttaggggtttatttacgtgggtacgtagtacgacgtaaacggaaccacgtacgtacggtcccttaccggttaacttaccggttttcgggaacccggtaacgggggaacccgtaaaggccgttaagggaacgttaaacgttaccgaaaacggtaaccgtgggtaacggtaccgtacggacctaaccgttaacgtttccg

SEQ ID NO: 391242 - DNA, 588 bp, Homo sapiens
  misc_feature: GZ8MTXP01DZX3U.39.81.H04.1.454.CMB.2.raw
  modified_base (481)..(481): a, c, t, g, unknown or other
  modified_base (486)..(486): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcagcgacttacaatggtacacaacaaacgtatcgaccacagaaccctccgagggaccaagaacgtacaccaatcgaccaacagacacatccagacgcacggaccaacatcggacctaggagacgcctgggacgatcgagacgacgacggccttagtacttacgngtcgngaagtgaggttacggggttaaattacgttttcgacgttcgggttaccctttcgtttacgaaccgttcgggtacggggcctaaccggggttaacccgttcggg

SEQ ID NO: 391243 - DNA, 684 bp, Homo sapiens
  misc_feature: GZ8MTXP01BI4F1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcagcgtcttacgaatggtacacaacaaactatcgaccacacgaaccctcgagggacaagcgtcaaccatcgaccacagaacacactaccaacgacgaccgacgaccctacacgtacgggacccgtggaaaaaaacgggcgaccgtaggggaacgtacgtacgtacggaaccggaaccggacccgggtacccggttaggttaacgttacgtacggttcggacggaacgggtaaggttaaacgggttaacgggggttaaaacgtttaaggttttacggttaaccgtttccggttaccccgtttaacgtttacgtaaccgttacgggtaccggggttacccggtaaccggggttaaccccgttaaccggg

SEQ ID NO: 391244 - DNA, 685 bp, Homo sapiens
  misc_feature: GZ8MTXP01A6LS3.39.81.H04.1.454.CMB.2.raw
  modified_base (239)..(239): a, c, t, g, unknown or other
  modified_base (272)..(272): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaaggcttntggttacacctttacactatgtatcagttggtncgacaggcccctggacagggcttgagtggatgggatggatcgagcgtcttaacaagtggtacaacaacaaactatcgacaacacgaaccctccgaaaggggcaaggacgtaccaacccgacgtacgaacccaacgaacgaaccaacaactacccgaaacggaacgaccgaaaccgggacccttaacgacgttacggacccgtaggaacgggaccgtaccggtaggaacgtacgtaccgtacggaaaccgaccgaccgggtaccgttaggttaacttaccgtggtcggaacggtaagggttacggtaacggttaacgggggtaaaatttcgttttacggaccgttacgggttaacccctttgtttaacggtaacgttacgggttacggggtaacccgttaacggggtaaccccg

SEQ ID NO: 391245 - DNA, 586 bp, Homo sapiens
  misc_feature: GZ8MTXP01ADT5U.39.81.H04.1.454.CMB.2.raw
  modified_base (252)..(252): a, c, t, g, unknown or other
  modified_base (269)..(269): a, c, t, g, unknown or other
  modified_base (280)..(280): a, c, t, g, unknown or other
  modified_base (309)..(309): a, c, t, g, unknown or other
  modified_base (328)..(328): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccgcctcatctcctgcaggtctagtcaaagcctacgtatacattgatgaaacnctatgattgtcagcagngcagccaatcncgagcactaatttagtagtttcaaccggntcgtcgggtaccagacagntcgaggcgcgaagtggtcagggcactgaattcaactaactagaaaatcagacgaggggtgaggtctaggaggtagttgggtttaggggtttattacgtgggtcaagtcggaacaaagggaaccacgtacgtacggtcccgtccgttaaaccgttaccgtttggggaacccgtaacgggggacccaaaggcgtaagggaacgttacgttaacgaaacggtaacgtggtaacggtctacggacctaaccgttgtttcccg

SEQ ID NO: 391246 - DNA, 565 bp, Homo sapiens
  misc_feature: GZ8MTXP01DV5IP.39.81.H04.1.454.CMB.2.raw
  modified_base (247)..(247): a, c, t, g, unknown or other
  modified_base (288)..(288): a, c, t, g, unknown or other
  modified_base (315)..(315): a, c, t, g, unknown or other
  modified_base (339)..(339): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctgtatacattgatagaaacnctacttgaattggtcagcagagccaggccaatctcaaggcncctaattataagttctaacggactcgnggggtccagacagattccagcggnagtcggtacaggcactgaattcaacatagaaatcagcgagggtggaggctaggaggtagttgggttagggttattacgtgcgtagtgacgtaaaggaacacgtacgtcggacccttaccgtacgtaccgttttacggacccgtaagggggaaccctaaggccgtaggagtaactaacgaaaacgttacgttagtaagggctcggcaccgttacttcgttcgttccc

SEQ ID NO: 391247 - DNA, 564 bp, Homo sapiens
  misc_feature: GZ8MTXP01CVB2K.39.81.H04.1.454.CMB.2.raw
  modified_base (559)..(559): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccggcctccatctcctgcaggtctagtcaaagcctgtatacattgatggaaacactacttgaattggttcagcagaggccaggccaatctaccgaaggcgaccttaatttagtaaggtttctaaccgggactcgtcggggtcccagacagtatcgagcgcgaaggtggtcaggcactagattcactatagaaatcgaagcgagggtggagcgtagaggtagttggttaggggtttattacgtgggactagtagactaaaggaacacgacgtcgggacccttaccgtactacgtttcggaaccgtaacggggaccagcgtaggagacgacgaaagtaacgtggtcggctacggactaacgnttccg

SEQ ID NO: 391248 - DNA, 712 bp, Homo sapiens
  misc_feature: GZ8MTXP01BT9OI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttggagtggatgggatggatcagcgcttacaatggtcacacaaactatgaccacagaaaccctccgaggggaccagaacgtccaaaccatcgaacccacacgaaccacactacccaacgacgaccgaaccgggtaccccttaacgacgtacgggaacccttagggaacgggaacgcccgttaggggaacgtacgttaccgtacggaaaccggaccgtaccggggcccgtttaggttaacgtttaacccgtgggttcggccggaaagggaacggttaacgggttaaccgggggttaaaattttaggtttttacgggttaaccgtttcggggttaaccccctttcggttttacggtaacccgtttacggggtccgggggaccccgtaacgggggttaaaccccccgtttcggggg

SEQ ID NO: 391249 - DNA, 597 bp, Homo sapiens
  misc_feature: GZ8MTXP01CX66Q.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctctgcaggtctagtacaaagcctacgtatacattgataggaaacacctattgaattggttcagcagagccaggccaatcacaaggcacttaattataaggtttccaacgggcttcgtcggggtacccagacagtattcgagcggacgaagggtgggtcagggacacgtagaacttcaacaactagaaactcgagcgagggtaggaggcgtaggagggtagttgggtttaggggtttaattacgtgggtactagtacgaacgaaacgggaaacacgtaccgtacggtcccttaccgttaacgtaccgtttcgggaacccgtaaggggaccctaaaggcgtaaggaagaacgttacgaaacgtaataggtggactgacctaacgaacgttc

SEQ ID NO: 391250 - DNA, 610 bp, Homo sapiens
  misc_feature: GZ8MTXP01C02QY.39.81.H04.1.454.CMB.2.raw
  modified_base (354)..(354): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctcctgcccgtcacccttggacagtcgcctcatctcctgcaggtctagtcaaagcctcgtatacattgataggaaacactacttgaattggttcagcagaggccaggccaaatctaccaaaggcgaccttaaatttaagtaaggttttctaaaccgggcttcgtggggtcccagacagattnagcgcaagtgggcagggcaactgaattcaacactagaaatcgaagcgagggtggaaggtcgtagagggtagttgggttaggggtttaattacgttaggtacgtagtagacgaaaggaaacaacgacgtacggccttaccggtaactacgttttcggaacccgtaacggggacccgaaagcgtaggaacgttaagttaccgaaaacggtaaccgttagttaacgggacgttacggaccgtaaacccgttcgtaaccg

SEQ ID NO: 391251 - DNA, 516 bp, Homo sapiens
  misc_feature: GZ8MTXP01BHPX3.39.81.H04.1.454.CMB.2.raw
  modified_base (287)..(287): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggtcagcagagcagccaatctcaaggcnctaatttataaggtttctaaaccggctcgtggggtacccagacagattccagcggcagtgggtacaggcactgaattcacactagaaaatcagcagggtgaggctaggaggtatggttgggttatacgtgcagtgacgaaaggaacacactggcctaccgtactcttttggccaggggaacctaagcgtgagatacaacgaacttgtaaggctgcaccgatcgttgttc

SEQ ID NO: 391252 - DNA, 563 bp, Homo sapiens
  misc_feature: GZ8MTXP01B0KZ7.39.81.H04.1.454.CMB.2.raw
  modified_base (344)..(344): a, c, t, g, unknown or other
  modified_base (370)..(370): a, c, t, g, unknown or other
  modified_base (427)..(427): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactntgaccacagaacctccgagggacagngtcaccatcgaccacagacacatccacgagcacggacctacagtcggacctgaggancctgggagatcagacgacgacggccgtagtacttacgtgtgcgaagaggagtacggggaaattacgtttgacgttcgggttaccccttgtttcgaaccgttacggtcgggggacctaacgggggaaccccttcggg

SEQ ID NO: 391253 - DNA, 577 bp, Homo sapiens
  misc_feature: GZ8MTXP01EQ3R6.39.81.H04.1.454.CMB.2.raw
  modified_base (372)..(372): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaagtggtacacaacaaactatgccacagaacctccgagggacagngtcacatcgaccacagacacatccacgacgcacgcctacagtacggacctgacggacgccgtagggagtatcgtacgaccgacgacggtccgttagttacttacgtgtgcggaagagagtacggggttaaattagtttcgacgttcggttacccttgtttagaaccgttacggtcggggaccctaacggggttaaccccgtcggg

SEQ ID NO: 391254 - DNA, 640 bp, Homo sapiens
  misc_feature: GZ8MTXP01AYM30.39.81.H04.1.454.CMB.2.raw
  modified_base (353)..(353): a, c, t, g, unknown or other
  modified_base (377)..(377): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcaggttgggtgcgacaggcccctggacgaagggcttggagtggagtgggatggatcgagcgtacttacaagtggtacacacaaactntcgacacagaacctcgaggacagngtcaccatacgaaccanacgacacactacccaacgagaccgacggaccctaacgaacgtcggaacctaggacggacgcccgtaggggacgacttcgacggaaccgaaccgaccgggtccgttagttaacgtttaccgtggtacggacggaaggaaggttaacggtacgggggttaaatttagtttcggaaccgtttcggttacccctttgttacgtaacgttaacgggtcgggggacccgtaacggggttaaccccgttcggg

SEQ ID NO: 391255 - DNA, 548 bp, Homo sapiens
  misc_feature: GZ8MTXP01AL0RV.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctcctgcaggtctagtcaaagcctgtatacattgatggaaacacctacttgaatggttcagcagaggccaggccaatctccaaggcgactaatttataaggtttcaaccgggactcgtggggtcccagacagtactttaggcgcaggtgggtacagggcacgtgaaattcacgtactagaaaatcagcaggggtggaggcgtaggaggagttgggtttaggggtttattacgtgacagtcggacgaaggaacacgtaacgtcggacctaccgtactacgtttcggccgaacggggaacaagttcgaggagataacaacgacttgtggctcgcacatcttgtcc

SEQ ID NO: 391256 - DNA, 721 bp, Homo sapiens
  misc_feature: GZ8MTXP01D7VRY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctcctgcaggtcttctgttactaccttacaatatgtatcgtagtggtgcgacgacggccctggacaagggtcttggaggtggagtgggatggatcgagcgtacttaacaagttcggaccaacgaacaaactgtacgaccaacgaacgtaaaccctcccgaagggggaccaagggcgtaccaaccaaatccgaaacccaacgaacgaaccaaccactacccgaacggagacccgtaaccgggaccctaacgacgtacgggaccttagggaacgggacgtcccgtaggggaacgtagttaccgtacggaaccggtaaccgaaccgggtccgttaaggtttacgttacgttggacggagggtaaggtaaggttaaacggggttacggggttaaaattttcggtttttacgaaccggttttcgggtttaacccctttcgtttaacggaaccgttaccgggtcggggttaaccccggtaacggggttaaccccgtttccggg

SEQ ID NO: 391257 - DNA, 715 bp, Homo sapiens
  misc_feature: GZ8MTXP01DOBLK.39.81.H04.1.454.CMB.2.raw
  modified_base (214)..(214): a, c, t, g, unknown or other
  modified_base (275)..(275): a, c, t, g, unknown or other
  modified_base (565)..(565): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgaaggtctctgcaaggtcttcgtgttactacctttacaatatggtatcgtaggttggngcgacgcggccctggaacaagggtcttggaggtggagtgggatggatcgagtcgtacttaacagtcggtacaacaaactaaactatcgacccaacaacgaacccgtcggaacgggaacaagaacgtaccaaaccgtagaacgaacccaacgaacgaaccctaacactacccgaacgacgaccggaacccggtacctaacgacgtaccgggaaccgtaggaacgggtacgccgtaggggaacgtacgtaccgacggaaccggtacgaccgggtcgttaagttacgttacgnggtcggaggtaaaggtaggttaacgggttaaaccggggttaaatttacggttttaccggaaccgtttccggtttaccccgtttaagtttaccggtaaccggtttacggggaccgggggttaccgtaaccggggttaaccccgtttccggg

SEQ ID NO: 391258 - DNA, 545 bp, Homo sapiens
  misc_feature: GZ8MTXP01A5L8P.39.81.H04.1.454.CMB.2.raw
  modified_base (275)..(275): a, c, t, g, unknown or other
  modified_base (343)..(343): a, c, t, g, unknown or other
  modified_base (513)..(513): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtncgacaggcccctggacaagggctgagtggatgggatggatcagcgcttacaatggtacacacaaactntcgcacagaacctccgaagggcaagagtcaccatcgaccacagacacataccacgagctacggcctacacgtggacctggacggagcccgtaggagatcgtgacgacacgggcctgtattacgtggtgcgagagagttacggggaaattgtttgacttggttaacccctntttgactacggttggggccaaggggtaacccc

SEQ ID NO: 391259 - DNA, 566 bp, Homo sapiens
  misc_feature: GZ8MTXP01DV0U2.39.81.H04.1.454.CMB.2.raw
  modified_base (343)..(343): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctccagggacagngtcaccatgaccacagacacatccacgagcacggacctacgatggacctgaggagcctggacgatcgtgacgacacggccgtagtattacgtgtcgcgaaggagagtcggggttaaattagttttgaacgttcgggttacccctgtttacgaacgttaacggtcgggggacccgtaacggggttaaaccccgttcgggg

SEQ ID NO: 391260 - DNA, 630 bp, Homo sapiens
  misc_feature: GZ8MTXP01DVBOR.39.81.H04.1.454.CMB.2.raw
  modified_base (252)..(252): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctgtatacattgatggaaacnctattgaattggttcagcagagccaggccaatctcaaggctacttaaatttataaggtttctaaccgggactcgtcggggtacccaggacagacttacaggcggcaaggtgggtcagggccaatgaattcaacactagaaatcagcgagggtggaggcgtaggaggtagttagggtttaggggtttaattacgttagggtacgtagttacggacgaaacggaaacctacgtacgtacggtacccgttacccgttaccgttaccgttttcgggaacccggtaacgggggaacccgtaaaggccgttagggaacgttaaacgttaccgaaaacggtaaccgtaggtaacggtacgtcggacctaaccgttaacgtttccg

SEQ ID NO: 391261 - DNA, 690 bp, Homo sapiens
  misc_feature: GZ8MTXP01BN5JN.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttacaactatggtatcgaggttgggtgcgacgacggcccctggacaagggcttgagtggagtgggatggatcgagcgtacttacaagtggtacaacgaacaaactatcgaccaacacgaaaccctccgaagggacaagcgtaccaaccatacgaacccaacgagaaccacacacccgaacgacggaccacggaccctaacacgtacggacctaggaacggacgaccgtagggaacgtacgttaccgtacggaaccgaaccgtacccgggtaccgttaggttaaccgtttaaccgtgggttacggaccgggaaaggtaacgggttaagggttaaaccgggggttaaaatttacggttttcgaaccggtttcgggttaacccctttggttacgtaaccgttacgggtccgggggaccgtaaccggggttaacccgttcccggg

SEQ ID NO: 391262 - DNA, 609 bp, Homo sapiens
  misc_feature: GZ8MTXP01AMB03.39.81.H04.1.454.CMB.2.raw
  modified_base (249)..(249): a, c, t, g, unknown or other
  modified_base (281)..(281): a, c, t, g, unknown or other
  modified_base (365)..(365): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgataggaaacnctacttgaattggtcagcagagcagccaatcncagcactaattagtaaggttcaacggctcgtgggacccagacagtattccgaggcggcaggtggtacaggcacgtgaattcaanactagaaaatcgagacgagggtggaggcgtaggaggtagttggtttaggggtttattaacgtgtacgtaggttacgaagtaaacgaaccgacgtaacgtcggtacccgtaccggttaacttaccggttttcgggacccggtaagggggaaccctaagggccgtagggaaacgtaacgtaacgaaaacggttacgttacggttggtacttcggttaaccctgttaccgttcgtttaaccgtttcc

SEQ ID NO: 391263 - DNA, 586 bp, Homo sapiens
  misc_feature: GZ8MTXP01CZ7JV.39.81.H04.1.454.CMB.2.raw
  modified_base (253)..(253): a, c, t, g, unknown or other
  modified_base (285)..(285): a, c, t, g, unknown or other
  modified_base (358)..(358): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagcccggcctccatcctcctgcaggtctagtacaaagcctacgtatacattgatgaaacnctatgaatggttcagcagaggcaggccaatcncaagcactaatttataggttctaacgggctcgtcgggtcccaagacagtacttcgagtcggcaggtgggtacnggcatagaaacttcaactaacagaaaatcgagacgagggtggaggcgtaggaggtagttgggtttagggtttaatacgtggactagtaggaacaaaggaacaacgtacgtggtaccctacgtacgtcgtttacgggaccgtaacggggaaccaggtacgagggtaacgacgttaaacgaaacggttaacgttgggacggccttaggaccttaacctaacttcgtttcg

SEQ ID NO: 391264 - DNA, 525 bp, Homo sapiens
  misc_feature: GZ8MTXP01BPFM1.39.81.H04.1.454.CMB.2.raw
  modified_base (292)..(292): a, c, t, g, unknown or other
  modified_base (356)..(356): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaatggttcagcagaggccaggccaatctccaaggcncctaatttataggtttctaaccgggactctggggtcccagacagattcagcggcaggtgggtcnggcactgaattcacactagaaaatcagcgaggggtggaggacgtggaggtagtggttggggttattacgtgcgatgacgaaggacacgactggcctcgtactacgtttcggccgtaagggaccaagcttaggaagattacgaaacgaactgtgctggcaactgttcctg

SEQ ID NO: 391265 - DNA, 531 bp, Homo sapiens
  misc_feature: GZ8MTXP01B60U9.39.81.H04.1.454.CMB.2.raw
  modified_base (369)..(369): a, c, t, g, unknown or other
  modified_base (466)..(466): a, c, t, g, unknown or other
  modified_base (499)..(499): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccccactccccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgccacagaacctccagggcagngtcaccatcgaccacagacacatccacgagcacggcctacatggacctgaggagcctggacgatctgacgacacggccgtgtattactgtgcgaagngatcggggaaatagtttgacgttggttaccctntttgaacttacgtgggacctgggaaccctcgg

SEQ ID NO: 391266 - DNA, 618 bp, Homo sapiens
  misc_feature: GZ8MTXP01AH8EU.39.81.H04.1.454.CMB.2.raw
  modified_base (277)..(277): a, c, t, g, unknown or other
  modified_base (426)..(426): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcgagttgggtncgacaggcccctggacagggcttgagtggatgggatggatcgagcgcttacaatggtcacacaaactatgaccactagaaccctccgagggacagcgtcaacccatacgaccaacagaccacatacccacgacgcaacggtccctaaanacgtacggaccgtagacggacgccgtagggagtacgtccgacggaaccgacgaccggtcgttagtacttacgtggtcgaggaaggtaacggttaagggttaaacggggttaaatttagtttacggttacgttcgttacccgttgtttacgaaccgttacgggtccggggaccgtaaccgggttaaccgtcgg

SEQ ID NO: 391267 - DNA, 677 bp, Homo sapiens
  misc_feature: GZ8MTXP01ELS8B.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttacaactatggtatcagttgggtgcgacacggcccctggacgaagggcttggaggtggagtgggatggatcgagcgtacttaacgaagttggtaccaacgaacaaaactatcgaccaacaacgaaaccctccgaaggggaaccaaggaacgtccaaccgatacgaacccaacgaacgaaccaacactacccgaacgacgaccgaaccgggaccccttaacgaacgttacgggaacccgttagggaacgggaacgcccgttaggggaacgtacgttaccgtacggaaccgacgaccgggccgttagtacttacgtgtgcggaagaagaggtacggggttaaattacgtttacgaacgttcggttaaccccttgttacggtaaccgttaacggcggggttacccgtaaccggggttaacccgttccggg

SEQ ID NO: 391268 - DNA, 568 bp, Homo sapiens
  misc_feature: GZ8MTXP01DKDSX.39.81.H04.1.454.CMB.2.raw
  modified_base (250)..(250): a, c, t, g, unknown or other
  modified_base (533)..(533): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtcctccctgcccgtcacccttggacagccgcctccatctcctgcaggtctagtcaaagcctcgtatacattgatagaaacnctatgaatggttcagcagagccagcaatctacagcacttaaatttataacggtttcaaccgggtactcgtcgggtacccagacagtacttcgaggcggcgtaggtcgggtacaaggtcaacgtagtaacttcaactaactaagaaaatcaaggacgaggggtaggacggacgtaggaagggtagttgggtttaggggtttaattacgtgacgtagtagacgaaggaacacgacgtcgcctaccgtactacgtttcggacgaagggtaccaggcgttaggaganacgaaacgacgtgtcgctcgacactcgttcgttcg

SEQ ID NO: 391269 - DNA, 552 bp, Homo sapiens
  misc_feature: GZ8MTXP01C7SWM.39.81.H04.1.454.CMB.2.raw
  modified_base (345)..(345): a, c, t, g, unknown or other
  modified_base (367)..(367): a, c, t, g, unknown or other
  modified_base (396)..(396): a, c, t, g, unknown or other
  modified_base (444)..(444): a, c, t, g, unknown or other
  modified_base (460)..(460): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgacttacaatggtcacacaaactntgccacagacctcgagggcagngtcacatcgaccacagacacatccagacncgacggactacatcggacctgaggagcctaggagacttcgagacgacnccggctagtacttacngtgcgaagagttagtacggggttaaattgtttagacgttcggttacccttgtttgaactttacggcgggggacctaacgggaacccttcggg

SEQ ID NO: 391270 - DNA, 668 bp, Homo sapiens
  misc_feature: GZ8MTXP01CHBTH.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacaggcccctggacaagggcttgagtggatgggatggatcgagcgacttacaagtggtacacaacaaactatgacccaacgagaaaccctccgaagggaccaagaacgtccaacccatcgaaccacagaccacatacccagacgaccaacggacctaacagtcggaaccctggaacgggacgacccgtagggggaacgtaacgttccgtacggaaaccgaccgaaccggggtacccgttaggttaacttaaccgtgtacgggacgaaggtaacggaaggttacgggggaaaatttaacggttttggaaccgtttcggttaaccccgtttcttttaacggtaaccgtttacgggcggggttacccggtaacggggttaacccccgttcgggg

SEQ ID NO: 391271 - DNA, 556 bp, Homo sapiens
  misc_feature: GZ8MTXP01BBRPX.39.81.H04.1.454.CMB.2.raw
  modified_base (252)..(252): a, c, t, g, unknown or other
  modified_base (357)..(357): a, c, t, g, unknown or other
  modified_base (408)..(408): a, c, t, g, unknown or other
  modified_base (436)..(436): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctattgaattggttcagcagaggccaggccaatctaccaaggcaccttaaatttagtaaggtttcaaccgggtactcgtgggggtacccagacagatcagcggnaagtgggtcaggcacgtgaattcactactagaaaatcagcgagggtgaggngtagagtagttgttggttagttagtggnagtagacgaacgaacgacgacgtacgtccgtaccgtacgtacgttcggtaaccggacgggacgacgacgtaggaagacgacgaaacgtaacgtagtcggcgtcgactaacgttaacgtcg

SEQ ID NO: 391272 - DNA, 713 bp, Homo sapiens
  misc_feature: GZ8MTXP01DVWCG.39.81.H04.1.454.CMB.2.raw
  modified_base (349)..(349): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaatatggtatcaggttgggtgcgacacgacccctggacaagggcttgagtggatgggatggatcagcgtacttacaatggtacaacaacaaaactntcgaccaacgaacgaaccctcgaaggggacaagaacgtcaaccatacgaacccacagaaccacactacccaacgacgaccaaccggacctaacgagtcgggaacccgtagggaacgggacgcccgttaggggaacgtaacgttaccgtacggaaccgaacccgtaccgggtacccggtttagttaacgtttaaccgtggttacggaccgggaaaggtaagggttaacggttaaaccgggggttaaaattttacggtttttacggttaaccgtttccgggtttaacccctttaaggttttaccggtaaccgtttaccgggtacgggggttacccgtaaaccgggggttaaccccgtttaaccggg

SEQ ID NO: 391273 - DNA, 584 bp, Homo sapiens
  misc_feature: GZ8MTXP01AGHW0.39.81.H04.1.454.CMB.2.raw
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggtagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatgggatcgagcgacttacaatgggtcaacacaaaactatgacaaccagaacctccgagggcaagacgtcaccatgaccanagacacatccacgacgcacggcctacactcggacctgacggacgccgtagacggatcgtgaccgacgacggccgtagttacgttacgtggtgccgaaggaagaagttacgggggtaaatttgtttagaacttcgggttcccttgtttcgacgttcgtcggggaccgacgggtaaccccgttgggtaaccccg

SEQ ID NO: 391274 - DNA, 676 bp, Homo sapiens
  misc_feature: GZ8MTXP01D6YUI.39.81.H04.1.454.CMB.2.raw
  modified_base (357)..(357): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctagtacagtctggagctgagatgacgaagcctggggcctcagtgaaggtctcctgcaaggtcttctggttacacctttacaactatggtatctaggttgggtgcgacgacggcccctggacgaagggtcttgaggtggatgggatggatcgagcgactttaacaatggtacaacaacaaactntcgaccaacaacgaaaccctccgaaggggacaagcgtaccaaccagtacgaacccaacgaacgacaacgactacccgaacgacgaccaacccgggacccttaaacagttaccgggaacccgtagggaacggaacgtccccgtaggggaacgtacgttccgtaacggaaacccggaaccgaccgggtaccgttagttacgttaaccgtggttacgcggaaagtaggttaaggtaacggggttaaattgtttacgaccgttcggttacccttgttacgtaaccgtacgggtcggggacctaacggggttaacccgtccggg

SEQ ID NO: 391275 - DNA, 598 bp, Homo sapiens
  misc_feature: GZ8MTXP01DH1FY.39.81.H04.1.454.CMB.2.raw
  modified_base (279)..(279): a, c, t, g, unknown or other
  modified_base (440)..(440): a, c, t, g, unknown or other
  modified_base (450)..(450): a, c, t, g, unknown or other
  modified_base (486)..(486): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacncggcccctggacaagggcttggagtggagtgggatggatcgagcgtcttaacgaagttggtacaacgaacaaaactagtcgacccaacaagaaccctccgaggggacagaacgtcaaccatacgaccacacgacacatccacgagcacgactacatcgacngaggagtccngggacatcgacgacgacgacggtcgttagtatacgngtcgacggaagagttaggtaacgggttaaattacgtttcggacgttcgggttaacccctttgttacgaaccgtttacgggcggggacccgtaacggggttaacccgttcggg

SEQ ID NO: 391276 - DNA, 552 bp, Homo sapiens
  misc_feature: GZ8MTXP01AKUZQ.39.81.H04.1.454.CMB.2.raw
  modified_base (357)..(357): a, c, t, g, unknown or other
  modified_base (548)..(548): a, c, t, g, unknown or other
tcagtcgcactagtcacgaccggtgctcgatttagtagtgtagattcgcgggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacacctattgaattggttcagcagacgccaggccaaatctaccaaggcgtaccttaaatttagtaacggtttacctaaccgggtactcgtacggggtcccagacagattnagcggcaaggtgggtcagggcacgtagaattcacactagaaatcagcgagggtggagctaggaggagttggttaggggttattacgtggtcgtaagtgaacgtaaggaaccacgacgtcggccttccgtactacgtttggaaccgaggggacagcgtaggagagttacaaacgtctgtgctgacctaacgngtcg

SEQ ID NO: 391277 - DNA, 619 bp, Homo sapiens
  misc_feature: GZ8MTXP01BAK6M.39.81.H04.1.454.CMB.2.raw
  modified_base (345)..(345): a, c, t, g, unknown or other
  modified_base (372)..(372): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacaggcccctggacaagggcttgagtggatgggatggatcagcgcttacaatggtcacaacaaactntagccacagaaccctccgagggccagngtcaaccatcgaccacagaccacatccagacgccacggaccctacagtcgggaaccctggaacggaacgtccgtaggggacgtacgtccgtagaccgaccgacgggtaccgttaggtacttacgtggtacgcggtaaggaaggttaggttacggggttaaatttcgttttacggaaccgttcgggttaaccccttgtttacggaaccgttacggtcgggggaccctaaggggttaaccccgttcggg

SEQ ID NO: 391278 - DNA, 580 bp, Homo sapiens
  misc_feature: GZ8MTXP01ARDML.39.81.H04.1.454.CMB.2.raw
  modified_base (376)..(376): a, c, t, g, unknown or other
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccccactcccaggttcagctggtacagtctggagctgagatgacgaagcctggggcctcagtgaaggtctcctgcaaggcttctggttacaccttttaccaactatggtatcagttgggtgcgacaggccccctggacaaggggcttgagtggatgggatggatcagcgcttacaatggtcacaacaaactatgacccacagaaccctccaggggacagngtcaaccatcgaccanagacacatccacgagcacggcctaacatcggacctgaaggagcctggggacgagtctaggaccgaacgaccgggtcccgtggtaacttacgtgtgcggaagaaggttagtacgggggaaattagtttgacgttcggttacccttcgtttcgaaccttacgtcgggggaccctaagggaaccccgtggg

SEQ ID NO: 391279 - DNA, 609 bp, Homo sapiens
  misc_feature: GZ8MTXP01AEDMY.39.81.H04.1.454.CMB.2.raw
  modified_base (346)..(346): a, c, t, g, unknown or other
  modified_base (373)..(373): a, c, t, g, unknown or other
  modified_base (388)..(388): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcagcgacttacaagtggtacacacaaactntcgccaacagaaccctccgagggcagngtcaccatcgaccanagacacatccacgagccacggcctaacacgtcggacctggacggacgcctaggggagatcgtaggaaccgacgacgggtccgttaggtaacttacgtggtcggcggaaggtaacgagggttaacgggggaaatttacgttttcggaccgtttcgggttaacccctttcgtttacgaaccgttacggtcggggggaccctaacgggggttaaccccttgggg

SEQ ID NO: 391280 - DNA, 588 bp, Homo sapiens
  misc_feature: GZ8MTXP01DSB9J.39.81.H04.1.454.CMB.2.raw
  modified_base (346)..(346): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcgagcgcttacaatggtcacaacaaactntgccacagaaccctccgaggggccagcgtcaaccatcgaaccacagacacatccaacgagccacggacctacatcggacctagaggaagcccgtaggggaagattccgtagaccgacaccgggccgtagtattacgtgtcgcgaagacgagtacgggggaaaattgtttagacgttcgggttaccccttgtttacgaacgtttaacggcgggggaccctaacgggggttaaccccgttcggg

SEQ ID NO: 391281 - DNA, 726 bp, Homo sapiens
  misc_feature: GZ8MTXP01B325V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttaccaactatggtatcaggttgggtgcgacacggcccctggacaagggcttggagtggagtggggatgggatcgaggcgtacttaacaagttcggtaccaacaactaaaactatacgacccaacacgaaccctccgaaggggaccaaggaacgtaccaacccagtacgaacccaacgacgtaacccacactaccccgaacggacgaccgaaccgggacccttaacgacgttacgggaacccgtagggaacgggacgccccgttagggggaaacgtacgtttaccgtacggaaccgaaccgtaccgggacccggtttagttaacgttacgttggtagggacggaaaggaacggttacgggttaacgggggttaaaattttaggtttttcggaacccggtttcgggttaacccctttcgttttacggaaccgtttacgggcgggggttacccggtaacggggttaaccccgttccggg

SEQ ID NO: 391282 - DNA, 561 bp, Homo sapiens
  misc_feature: GZ8MTXP01DD6B2.39.81.H04.1.454.CMB.2.raw
  modified_base (342)..(342): a, c, t, g, unknown or other
  modified_base (429)..(429): a, c, t, g, unknown or other
  modified_base (438)..(438): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaattggcacacaaactntagaccacagaaccctccgaggggccaagaagtccaaccatcgaccacagacacatccacgagcacgcctacatcgacctgaggacncctaggagntccgagacgacgacggccgtagtactacgtgtcgcgtaagagagtacggggaaatttagtttgaacgttcggttacccttgtttagaaccttacggcggggaccgtaacgggaacccgttcgg

SEQ ID NO: 391283 - DNA, 609 bp, Homo sapiens
  misc_feature: GZ8MTXP01A1TOX.39.81.H04.1.454.CMB.2.raw
  modified_base (391)..(391): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccgcctccatcctcctgcaggtctagtcaaagcctcgtatacattgataggaaacaccttatagaattggttacagcagagccaggaccaatcctacgaaggccgtaccttaaatttaacgtaacggtttacgtaaaccgggtacttcggtacggggtacccaagacagtacttcgagcggctaggtcgggtacnggacacgtagtaacttcgaacactagaaatcgaaggcgaggggtggaggtctaggtaggtagttgggttaggggtttatacgtgacgtagtacgacgaaacggaacacgtcgtacggacccttaccggtacttacgtttcgggaccgaacgggggtaccaaggtcgttaggaaagtacttaacgaaacgagtgtggctcgaccttactaacgttctcg

SEQ ID NO: 391284 - DNA, 596 bp, Homo sapiens
  misc_feature: GZ8MTXP01A2CCL.39.81.H04.1.454.CMB.2.raw
  modified_base (343)..(343): a, c, t, g, unknown or other
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgaccacagaacctccgagggcagngtcaccgatcgaccacagacacatccaacgagacacggcctacagtcggacctgacggagcctaggggaagatccgtagaccggacgaccgggtccgtagttacttaccgtggtcggacggaaggtaaggaggtacgggggttaaaattagttttaggaccgttcgggttacccctgttttacgaaccgttacggtgggggacccctaacgggggaaccccgttcggg

SEQ ID NO: 391285 - DNA, 703 bp, Homo sapiens
  misc_feature: GZ8MTXP01AWBT1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaggtcttcgtgttactacctttaccaatatggtatcgtaggttgggtgcgacgacggccccgtggacgaagggtcttaggaggtggagtgggagtggatcgagcgtacttaacgagtggtacaacaacaaactgtacgaccaacgacgaacccgtccgagggaacaagcgtaccaaccgatacgaacccacaacgaaccacactaccgaacggacgaccgaccggtaccctaacgacgtacgggacccgtagggaacgggaccgaccgtaggggaagtacgttaccgtacggaaacccgtaccggtaccgggtcgttaacggttaacttaccggtggtacggacggtaaggtaacggttaggtaacggggttaaatttacgtttacggttaccgtttcggttacccgttggtttacggaacccgtttacggggtccggggttaccgtaaccgggggttaaccccgtccggg

SEQ ID NO: 391286 - DNA, 663 bp, Homo sapiens
  misc_feature: GZ8MTXP01EEU7S.39.81.H04.1.454.CMB.2.raw
  modified_base (414)..(414): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacaagggcttgagtggatgggatggatcgagcgacttacaagtggtacaacaacaaaactatcgacccacaacgaaccctccgaggggaccaaggaacgtccaaccatcgaaccacagaacacanaccacgagccacggaccctaacagtacggaccctggaacggacgcccgtagggaacgtacgtcctaggaaccgaaccgaccggtaccggttagttaacgttaaccgtggtacggacgggaaaggtaagggttaaggttaacgggggttaaaatttaacggtttttcgaaacggtttccgggttaacccctttgtttacggtaaccgttaccgggtcgggggacccgtaacggggttaaccccgttcggg

SEQ ID NO: 391287 - DNA, 594 bp, Homo sapiens
  misc_feature: GZ8MTXP01BNIDL.39.81.H04.1.454.CMB.2.raw
  modified_base (329)..(329): a, c, t, g, unknown or other
  modified_base (349)..(349): a, c, t, g, unknown or other
  modified_base (373)..(373): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggagtgggatggatcgagcgcttanaagtggtacacaacaaactntgaccacagaaccctcgaggcagngtcaccatcgaccacagacacatacccagacgcacggacctacgatcggacctggaagacgccgtagggaacgtactccgtaggaacccgacgaccggtccgttagttaacttcgtgtcgacggaagaacggagtaacggggaaatttagtttcgacgtttcggttaccccttgttcgaaccgttacgggcggggaccgtaacggggttaacccgttcggg

SEQ ID NO: 391288 - DNA, 668 bp, Homo sapiens
  misc_feature: GZ8MTXP01DSBJO.39.81.H04.1.454.CMB.2.raw
  modified_base (279)..(279): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtctccctgcccgtcacccttggacacgccgcctccatctcctgcaggtctagtacaaagcctagtatacattgaatacggaaacacttacttgaattggttacagcaagnggcaggcaatctaccaaggctaccttaatttagtaacggtttcgaaccgggtctcggtgggtacccagacagtacttcgaggcggtacaggttcgggacaagggcaacgtagtaaacttccaactaacgtaagaaaacttccgaaagggacggtaagggggttaggacgggtacggttagggaagggttagtttaggggttttaggggtttaattacgtggtacgtaagttacggaacgaaacgggaaccacgtaccgtcgggtacccttaccgtacgttacgtttacgggaccggaaacggggaccttaaggcgttagggaaacgtacgttaaaccgaaacgttaacgtgggtacggtaactacggacccttactaacgttcctttcg

SEQ ID NO: 391289 - DNA, 683 bp, Homo sapiens
  misc_feature: GZ8MTXP01AX23C.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccccactcccaggttcagctggtacagtctggagctgagatgacgaagccgtggggcctcagtgaaggtctcctgcaaggtcttctggttacacctttaccaactatggtatcgaggttgggtgcgacgacggcccctggacgaagggcttggagtggagtgggatggatcgagcgactttacaagttggtacaacaacaaactatacgaccccaacaacgaaacccctccgaagggaccaagaacgtaccaacccgaagtacgaaccccaacgaaagaacccaaccacgtaacccacggaacgaccgaacggaccctaacgacgtacgggaccgtaggaacggacgcccgtagggaacgtactccgtacgaaccggaccgaaccgggccgttaagttacgttaccgtggttggacgtaaaggaacggttacgggtaacggggttaaatttaggttacgttaccgttcggttaccccttgttacgtaacgttacggtcggggaccgtaacgggttaaccccgtcggg

SEQ ID NO: 391290 - DNA, 659 bp, Homo sapiens
  misc_feature: GZ8MTXP01CILOD.39.81.H04.1.454.CMB.2.raw
  modified_base (417)..(417): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctggttacacctttacactatggtatcaggttgggtgcgacgacggcccctggacgaagggtcttggagtggagtggggatggatcgagcgtcttaacgaagtcggtacaacgaacaaactgtcgacaacagaaccctccgaaagggacaaggacgtaccacctagtacgacccanacgaccacaactcccgaacgacgccgaaccggacctaacgacgtacggacctaggacgggacgtccgtaggacgtactacgacgaaccggacgaccgggtccgttagttacgttacgtggtcgcggaagaggtacgggttaacgggggtaaaattttcggttttacgggaccgtttcgggtttaaccccttgtttaacgaccgttacgggttcggggtaacccgttaaccgggggtaacccg

SEQ ID NO: 391291 - DNA, 774 bp, Homo sapiens
  misc_feature: GZ8MTXP01C966S.39.81.H04.1.454.CMB.2.raw
  modified_base (442)..(442): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgcttaacaagttggtacactaacaaaactatcgaccaacgacgaaaccctccgaaggggaccaaggtaacgtaccaaacccaaagttacggaaaccccaaacgaacgaaacccaacctaacnccccgaaacggaacggtacccaaacccggggaccccttaaacacgttacggggaaaccctagggaacgggaaacgccccgttagggggaaaggttaactttaccggtaacggaaacccggaaccggacccgggggtaccccggttttaagggtttaaactttaaccggtttggtacgggaccggtaaaggaaacgggttaagggttaaaccgggggttaaaaagttttaacggtttttaggaaacccgttttcgggtttaaccccctttggttttacggaaccgtttaacgggtcgggggttacccgtaacggggttaaaccccgtttcggg

SEQ ID NO: 391292 - DNA, 548 bp, Homo sapiens
  misc_feature: GZ8MTXP01AZIVB.39.81.H04.1.454.CMB.2.raw
  modified_base (343)..(343): a, c, t, g, unknown or other
  modified_base (367)..(367): a, c, t, g, unknown or other
  modified_base (512)..(512): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctcgagggacagngtcaaccatcgaccacagacacatccacgagcacgacctacatcggacctgaggacgcctgggagatcgtagacgacgacggccgtagtacttacgtgtgcgaagagagtacggggaaatttagtttgacgttcggttacccttntttgaactacggtggggacctaacgggaacctcggg

SEQ ID NO: 391293 - DNA, 576 bp, Homo sapiens
  misc_feature: GZ8MTXP01BKC51.39.81.H04.1.454.CMB.2.raw
  modified_base (349)..(349): a, c, t, g, unknown or other
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacacggcccctggacaagggcttgagtggatgggatggatcgagcgctttacaatggtacacaacaaactancgccacagaaccctcgaggggaccagcgtcaccgatcgaccanagacacatccacgagcacggacctaacagtcggacctggacggagcccgtagggacgactcgagaccgaccgcggccgtagttactacgtgtggcgaagagaggtaacgggttaaattgtttgacgttcggttacccttcgttagtaaccgtacggtcgggaccgtaacgggttaacccgtcgg

SEQ ID NO: 391294 - DNA, 612 bp, Homo sapiens
  misc_feature: GZ8MTXP01AH4YX.39.81.H04.1.454.CMB.2.raw
  modified_base (377)..(377): a, c, t, g, unknown or other
  modified_base (387)..(387): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctctgcaggtctagtcaaagcctagtatacattgataggaaacacctattgaatggttcagcaggacggccaggccaatcctaccgaaggccgtaccttaattttaacgtaacgggttttcctaaaccggggtacttcggtcgggggtacccagacagtacttcgagcggnaggtgggtcnggcagtgaacttcacactagaaatcgagcgagggtgaggtcgtaggaggtagttgggttagggtttaatacgtgacgtagtaggaacgaaacggaacacgtacgtcggtacccttaccgtacttacggtttacggacccggtaaggggtaaccaggtcgttagggaacgtaacttaccgaaaacgttacgtgggtacgccgtacgaccgaacctcgttcgttccg

SEQ ID NO: 391295 - DNA, 591 bp, Homo sapiens
  misc_feature: GZ8MTXP01CU4LB.39.81.H04.1.454.CMB.2.raw
  modified_base (363)..(363): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctcatctcctgcaggtctagtcaaagcctcgtatacattgatggaaacactacttgaattggttcagcagaggccaggccaaatctaccaaggcgaccttaaatttataaggtttcctaaaccgggactcgtacgggggtcccagacagattcgagcggnaagggtgggtcagggcaactgaaacttcaacactagaaatcgaagcgaaggggtggaaggcgtagggtagggtagttgggttaggggtttaattacgttggacgtagtagacgtaaaggaacacgacgtacggcctaccgtactcgtttcggaaccgtaagggaccaaagcgtaggagaacgttacgaaacgtaacgtggtcggactcgacctaaccgttaagttccg

SEQ ID NO: 391296 - DNA, 583 bp, Homo sapiens
  misc_feature: GZ8MTXP01D3WZL.39.81.H04.1.454.CMB.2.raw
  modified_base (326)..(326): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtctccctgcccgtcacccttggacagccgcctccatcctcctgcaggtctagtacaaagcctcgtatacattgataggaaacacttattgaattggttcagcagagccaggccaatccacgaagctaccttaaatttataacggtttcgaaccgggntcggtcgggtcccaagacagtactcgagcggcaggtcgggtcaagggcacgtagaacttcaactactagaaatcgaggcgaggggtggaggctaggtaggtagttggttggggtttattacgtgacgtaagtgaacgaaggaacacgacgtcgtacccgtccgtacgtacgttcgggaccgaacgggtaccaaggtcgttaggacgtaagttaacgaaacgttacgtggtcggctacgacacctaagttccttaacg

SEQ ID NO: 391297 - DNA, 665 bp, Homo sapiens
  misc_feature: GZ8MTXP01A7KKX.39.81.H04.1.454.CMB.2.raw
  modified_base (256)..(256): a, c, t, g, unknown or other
  modified_base (272)..(272): a, c, t, g, unknown or other
  modified_base (550)..(550): a, c, t, g, unknown or other
tcagtcgcactagtcacgaccggtgctcgatttagtagtgtagattcgcggggacccaaaaaccacacccctccttgagagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaggcttctggttacaccttacaactntggtatcgagttggtncgacgacggcccctggacagggcttggagtggatgggatggatcgagcgtacttacaagttcggtacaacgaactaaactatcgaccaagaacgtaaccctccggaaagggaccaaggtacgtaccgaaccctagtaccggaaacccacgaacgaaccactactacccgaacgacgaccgtaaccccgggaccttaacgacgttaccgggacgtggaagggtacgccggttagacggtatcgtacgaccgcgaccggtccgttagtaacgttcgtggnggaacggaaggacggtaaggttacggggtaaatttcgtttacggaccgtttacggtaacccctttgtaacggtaccggtaccggttacggggtaacccgaacgggttaaccccgg

SEQ ID NO: 391298 - DNA, 620 bp, Homo sapiens
  misc_feature: GZ8MTXP01AXXIP.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccggcctccatctcctgcaggtctagtcaaagcctacgtatacattgataggaaactctactgaattggttcagcagacggccaggccaatctaccgaaggctaccttaaatttacgtaacggtttcaaccgggtctcgtcggggtacccagacagattcgaggcggcgaagggtgggtcagggcaacgtgaacttcaactacgtagaaatcgagcgaggggtggaggcgtaggaggtagttgggtttaggggtttattacgtgggtacgtaagtgaacgtaaaggaaccacgtacgtacggtccttaccggtacgttacggtttcgggaaccggtacggggaccaaggttcgtagggaacgttacgttaacgaaaccggtaagtgggtaaccggtcgtacggacctaacgttaacgttcg

SEQ ID NO: 391299 - DNA, 606 bp, Homo sapiens
  misc_feature: GZ8MTXP01BIBZU.39.81.H04.1.454.CMB.2.raw
  modified_base (372)..(372): a, c, t, g, unknown or other
  modified_base (420)..(420): a, c, t, g, unknown or other
  modified_base (587)..(587): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctccatctcctgcaggtctagtcaaagcctacgtatacattgatacggaaacctactacttagaattggttcagcagaggccaggccaatctacaaggcctacttaaatttagtaaacggtttcctaaaccgggtactcgtacggggtcccagacagacttcgaggcggntaaggtgggtcagggaccactagaacttcaactaactagaaatcgagnggagggtggacggtgtaggagggtagttggtttaggggtttatacgtggctaagtgacgtaaaggaacctacgtaacgtcggtcccttaccggtaacttcggtttcggaaccgaacggggacctaaaggcgtaagggaattacgttacgaaacgtaacgtgaagtcncgactaaccgttaagttcg

SEQ ID NO: 391300 - DNA, 681 bp, Homo sapiens
  misc_feature: GZ8MTXP01BR4EF.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaatatggtatctaggttgggtgcgacacggcccctaggacaagggcttggaggtggagtgggatggatcgagcgacttacagtcggtacaacgaactaaactagtgacccaacaacgaaccctcccggagggaccaagcgtaccaaaccgagtacgaacccaacagaacccacaactaccaacgacgaccgaaccggacctaacacgtacggaacccgtggaacggacgtccgtagggaacgtacgtaccgtacggaaccgaaccgaccgggtccgttagttaacgttagttggtacggacggaaggtacggttaaaggttacggggttaaatttacggtttgaccgtttacggttaccccgtttgtttcggtaaccgttacgggtcggggttacccgtaaccggggttaaccccgttaaccggg

SEQ ID NO: 391301 - DNA, 585 bp, Homo sapiens
  misc_feature: GZ8MTXP01BE55N.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactactgaatggttcagcagaggccaggccaatctaccaaggcgtaccttaaatttataacggtttctaaacccggggcttcgtggggtccccagacagacttcagcggcaggtgggtcaaggcacgtgacttcacactagaaatcagcgagggtggagctggaggtagtggttgggtttatacgttgcagtgacaaggaacacgacgtggacccttcgtactacgttttcgggaccgaagggggacccaaaggtcgttagggaaagtaacgttacgaaaaccggaaacgttgggtacggggccttcgggaccttaacccgtaattccgtttccgg

SEQ ID NO: 391302 - DNA, 625 bp, Homo sapiens
  misc_feature: GZ8MTXP01EV4IO.39.81.H04.1.454.CMB.2.raw
  modified_base (261)..(261): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacttantgtatctagtggtgcgcgacgccgcgacgacggtacgtaggtaggtacggtacggtacggagtcgacgtacgacgtacgtactacgtacgacgacaacaactacgacgaccgacgacgacgacgacgaacgacgaacacacacacacacacacacacacgacgacgacgacgtacgacgacgacgacgacgacgacgacgacggacgtacgtacgtacgacgacgtaccgtacgtacgtacgtagtagtacggtaaggtaacggtaacggttaacggtaacgttacgttacgttacgttacgttccgttaccgttaacgtacggtaaccgtaccggtaccggttaccggtaaccgttccgtccg

SEQ ID NO: 391303 - DNA, 609 bp, Homo sapiens
  misc_feature: GZ8MTXP01BLV73.39.81.H04.1.454.CMB.2.raw
  modified_base (249)..(249): a, c, t, g, unknown or other
  modified_base (286)..(286): a, c, t, g, unknown or other
  modified_base (352)..(352): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctcagtctccctgcccgtcacccttggacagccggcctccatctcctgcaggtctagtcaaagcctcgtatacattgatggaaacnctattgaatggttcagcagagcaggcaatctcaagcncctaaatttataaggtttcaaccgggatcgtcggggtcccagacagacttcgagcgcagtgggtcnggcactgaattcgacactagaaatcgaagtcgagggtaggaggacgtaggtaggtaagttggttaggggtttaattaacgtggactagttaggaccgaaagggaaccacgtacgtacggtacccgttaccgtaacgttacgtttacgggcccgaaacgggggtaacccaagggtccgttagggggaaactaagttaaccgaaaacgttaaccgtttggcggggtaacttgggaccttacccgtaagttcctttaacg

SEQ ID NO: 391304 - DNA, 697 bp, Homo sapiens
  misc_feature: GZ8MTXP01AVH1F.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttactacctttaccaactatggtatcagttgggtgcgacacggcccctggacaagggcttgagtggagtgggatggatcagcgacttacaatggtacaacaacaaactatcgaccacaagaaaccctccgaaggggaccaaggaacgtccaacccatacgaacccacgacgaaccaacactacccgaacgacgaccgaaccggaccctaacgacgtacgggaaccctaggaacgggacgtacccgtaggggaacggtacttccgtacggaacccgaaccgaccgggtacccggttaggttaacgtttaaccgtggtacggaccggaaaggtaggttaaacggtaacgggggttaaaatttacggttttacggttaaccgtttcgggttaacccctttcgtttacgtaaccgttaccgggttcgggggaccccgtaacggggttaaccccgttccggg

SEQ ID NO: 391305 - DNA, 579 bp, Homo sapiens
  misc_feature: GZ8MTXP01CBO7G.39.81.H04.1.454.CMB.2.raw
  modified_base (340)..(340): a, c, t, g, unknown or other
  modified_base (366)..(366): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggctcagtgaaggtctctgcaaggcttctgttacacctttacaatatggtatcagttgggtgcgacaggcccctggacaagggcttgagtggatgggatggatcagcgacttacaatggtacacacaaaactntgaccacagaaccctccagggacagngtcaaccatcgaccacagtacacatccacgacgcacggacctacgatcggacctgaacggagccgtagggacggtatcgtacggacgaaccgacggtccgtagtacttaccgtggtcgacggaaggagaggtacggggaaattagtttcgacgttcgggttacccttgttacgtaacgtacggtcgggaccgtaacgggttaacccgttcggg

SEQ ID NO: 391306 - DNA, 688 bp, Homo sapiens
  misc_feature: GZ8MTXP01C4GB0.39.81.H04.1.454.CMB.2.raw
  modified_base (350)..(350): a, c, t, g, unknown or other
  modified_base (386)..(386): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgcttacaagttggtaccaacaacaaaactntacgacccaacaacgaaccctccgagggaaccaggngtccaaccatcgaaccacaagacacatacccagacgaccaccggaccttacgaagtcggaccgtaggacggacgcccgtagggaaacgtacgttaccgtaggaacccgaaccgaaccggggtcccgttagttaacgttaccgtgggtacgaccgggaaagggtaaggttaacgggttaacgggggttaaaattttacggttttacggaaaccggtttcgggtttaaacccctttcgttttaccggtaacgttaaccggggttcgggggaaccccgtaacgggggttaaccccgtttccgggg

SEQ ID NO: 391307 - DNA, 539 bp, Homo sapiens
  misc_feature: GZ8MTXP01AII3P.39.81.H04.1.454.CMB.2.raw
  modified_base (344)..(344): a, c, t, g, unknown or other
  modified_base (420)..(420): a, c, t, g, unknown or other
  modified_base (463)..(463): a, c, t, g, unknown or other
  modified_base (465)..(465): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacaatggtcacacaaactntgccacagaacctccagggcagaagtcaaccatcgaccacagacacatccacgacgcacggacctacgatggaccngaggacgcctggagatcagacgacacggcctgtacttactggngngaagagagtagggaaattagtttagacgttcgttaccttgttagaacgtcggcgggactaacgggttaaccgtg

SEQ ID NO: 391308 - DNA, 687 bp, Homo sapiens
  misc_feature: GZ8MTXP01D8D3Z.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacaactatggtatcagttgggtgcgacacggcccctaggacaagggcttgagtggatggggatggatcgagcgtacttaacaaagttggtacaacaacctaaaactatcgacccaacgaacgaaccctccgaagggaccaagaacgtcaaccaatcgaacccagacgaaccacactaccgaacgacgaccacggaccctaacgacgttacggaacccgaggaacggaacgcccgttagggaacgtacttccgaggaccgaaccgaccgggtccgttaggtactttaacgtggtacgacggaaagtaaggacgggttaaacggggttaaatttacggttttacggaaccgttcgggtttaaccccttcggttttacgaacccggtttacggggttaccgggggacccgttaacccgggggttaaccccgtttccgggg

SEQ ID NO: 391309 - DNA, 701 bp, Homo sapiens
  misc_feature: GZ8MTXP01AH7BT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgaggttgggtgcgacacggcccctggacaagggcttggaggtggagtgggatggatcgagcgtcttacaagtggtacacaacaaactatcgaccaacacgaaaccctccgaggggaccaagcgtccaaccatcgaaccacagaaccacactacccaacgacgaccgaccgggaccctaacacgttacgggaacccgtagggaacggacgccgtaggggaacgtacgttccgtacggaacccgaccgtaccggggtcccggttagttaacgtttaccgtggtacggaccgggtaaggtaacgggttaggttaaaccgggggttaaattttacggttttacggttaaccggtttcgggtttaacccctttcgttttacggaaccgtttaccgggtacgggggttaccccgtaacgggggttaaccccgtttccgggg

SEQ ID NO: 391310 - DNA, 560 bp, Homo sapiens
  misc_feature: GZ8MTXP01BQH42.39.81.H04.1.454.CMB.2.raw
  modified_base (326)..(326): a, c, t, g, unknown or other
  modified_base (343)..(343): a, c, t, g, unknown or other
  modified_base (367)..(367): a, c, t, g, unknown or other
  modified_base (517)..(517): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttanaatggtcacacaaactntgccacagaacctccagggacagngtcaccatcgaccacagacacatccacgagcacggcctacatgggacctgaggagccgtagggagtatctaggaccgacgacggccgttagtattacgtgtcgcgtaagaagaggtacggggaaattgttttagacgttcggttaccctntttgaaccttacggtcggggcctaacggggttaacccgtcggg

SEQ ID NO: 391311 - DNA, 688 bp, Homo sapiens
  misc_feature: GZ8MTXP01A82L9.39.81.H04.1.454.CMB.2.raw
  modified_base (281)..(281): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgctcactcccaggttcagctggtacagtctggagctgagatgacgaagccgtggggcctcagtgaaggtctcctgcaaggtcttctgttacctacctttacaactatggtatcgtaggttgggtncgacgacggcccctaggacgaagggctaggagtggagtggggatggatcgagcgtattacgaagtcggtacaacaacaaactgtacgaccaacaacgaaccctcgaaagggaccaaggacgtaccaacctactacgaacccaaacgacgaccaacactacccgaacgacgaccgaaccggtaccctacgacgtcggaacctggaacggaccgaccgtaggaacgtactaccgtaggaacccgacgaccggtccggttataacgttacgtgtcggaacggaaaggttaggtacgttaaacggggtaaatttcggttttacgttaccggtttaccggtttaacccctttcgtttaacggaacccggttacgggttaccgggggtaacccgttaacgggggttaaccccg

SEQ ID NO: 391312 - DNA, 627 bp, Homo sapiens
  misc_feature: GZ8MTXP01AS0KP.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtaatacattgataggaaacacctacttgaattggtcagcagaggccaggccaatcctccgaaaggccgtaccttaaattttagtaacggttttcgtaaaccgggtacttcgtcgggggtaccccagacagacttcgaggcggcaggtggggtacagggcacgtgaaattcacactagaaatcagcgaggtggaggcgtaggaggtagtggttagggttaaattcgtagtcgagtcgacgtaaaggaccacgacgtcggtacccgttacgtacctacgttttacggaccgtacgggggtaaccaacggttccgtagggaacgtaacgtaaccgaaaaccggttacgttcgggtaacgggtcgttaacggacctaccgttacgttcgttcgtttaaccg

SEQ ID NO: 391313 - DNA, 661 bp, Homo sapiens
  misc_feature: GZ8MTXP01B9K7B.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatctagttgggtgcgacacggcccctggacgaagggcttgagtggatgggatggatcagcgactttaacaagttggtacaacaaccaaacgtatacgacccaacgagtaaccctccgaaggggacaagaacgtccaaaccatacgaaccaacgaacgaaccacactaccaacgacgacctacggaccctacagtcgggaaccctggaggacgcccgtaggggagtatccgacggaccgaacgacccgggtaccgttaggtaacttaccgtaggtggcggaaaggaaggttacggttaacggggttaaatttaggttttgaaccgttcgggttaaccccttgtttacgaaccgtttacgggtccgggggaccgtaacggggttaaccccgttaacgggg

SEQ ID NO: 391314 - DNA, 621 bp, Homo sapiens
  misc_feature: GZ8MTXP01CB3JQ.39.81.H04.1.454.CMB.2.raw
tcagtcgcactagtcacgaccggtgctcgatttagtagtgtagattcgcggggacccaaaaaccacacccctccttgggagaattccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcaggttggtgcgacgaggcccctggacaagggcttgagtggagtgggatggatcgaggcgtactttaacaagttggtaccaacgaactaaactatgacccaacacgaaccctccgagggaccagcgtcacatgaccacacgacacatacccgacgacgcaccggacctacagtcggacctggaggacgcctagggacgtattccgaggaccgaccgtacgggccgttagtacgttacgtggtacgcggaaggtaagttacgggtaaacggggttaaatttagtttcgacgttcggttacccttcgtttacggaaccgttacgggtcggggacctaacggggttaacccgttccggg

SEQ ID NO: 391315 - DNA, 636 bp, Homo sapiens
  misc_feature: GZ8MTXP01AK3O3.39.81.H04.1.454.CMB.2.raw
  modified_base (372)..(372): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcaggttgggtgcgacacggcccctggacaagggcttgagtggatgggatggatcagcgtcttacaagtggcaacaacaaactatgaccacagaacctcgaggacagncacatcgacacacgacacactaccacgacgaccgacgaccctacacgtacgggacctagggaacggacgcccgtaggggaacggtacgtaccgtacgggaaccggaaccgtacccggggaccgtttaggtacgtttaaccgtggtacggacggaaggaaggttacgggtaacggggttaaatttgtttacggttacgttcggttacccttgtttacggtaacgttaccggtcgggggacccgtaacggggttaacccgttcggg

SEQ ID NO: 391316 - DNA, 645 bp, Homo sapiens
  misc_feature: GZ8MTXP01EVWDZ.39.81.H04.1.454.CMB.2.raw
  modified_base (282)..(282): a, c, t, g, unknown or other
  modified_base (340)..(340): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggtcagcagagcagcaatcncaagcactaattataaggtttcaacggactcgtgggtcccagacagattccgagcggngaggtgggtacaggcactagaattcaactactagaaaactcgagacgaggggtggaggcgtaggagggtagttaggggtttaggggtttaattaacgttgtacgtaaggttaggacgaaaacgggaaacaacgtaaccgtacgggtacccgttacccggtaaccttaaccgttttaccgggacccggaacgggggaaacccgaaacggttacggtaacgggaaagggtaacttaaccgaaaaaacggaccgttagggtaacggtccgtaacggaccctaccttaacgttccgtttaacgtttccc

SEQ ID NO: 391317 - DNA, 543 bp, Homo sapiens
  misc_feature: GZ8MTXP01CJI92.39.81.H04.1.454.CMB.2.raw
  modified_base (345)..(345): a, c, t, g, unknown or other
  modified_base (371)..(371): a, c, t, g, unknown or other
  modified_base (415)..(415): a, c, t, g, unknown or other
  modified_base (420)..(420): a, c, t, g, unknown or other
  modified_base (458)..(458): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcgagcgcttacaatggtacacacaaactntagccacagaaccctcgagggacagngtcacatcgaccacagacacatccacgagcacgctacatcgacngagcnctggagatcgtagacgacgacggccgtagtacttacgngtcgcgtaagagagtacggggttaaattagtttgacgttcgttaccctgttagaactaggcgggacctaacgggttaaccctcgg

SEQ ID NO: 391318 - DNA, 549 bp, Homo sapiens
  misc_feature: GZ8MTXP01ARTX0.39.81.H04.1.454.CMB.2.raw
  modified_base (275)..(275): a, c, t, g, unknown or other
  modified_base (384)..(384): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtncgacaggcccctggacagggcttgagtggatggggatggatcagcgcttacaatggtcacacaaactatcgacacagaacctcgaagggcaagagtcaccatcgaccanacgacacatccacgagcacggcctacatcggacctgacgagccgtgagatcgtgaccgcgaacggccgtgtattacgtgtgcgagaggagttacggggaaattgtttgcttcgggtaaccccttgtttcgacttacggttcgggggtccgaacggggtaaccccg

SEQ ID NO: 391319 - DNA, 676 bp, Homo sapiens
  misc_feature: GZ8MTXP01DGFIR.39.81.H04.1.454.CMB.2.raw
  modified_base (409)..(409): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacaactatggtatcaggttgggtgcgacgacggcccctggacgaagggtcttggaggtggagtgggatggatcgagcgtcttacaagtcggtactaacaactaaactatcgacccaacgagaaccctccgaagggacaagcgtcaaccatcgaaccanacgacacactccgaacgacgtaccaccggaccctaacgacgtacgggaaccctgggaacggacgaccctaggggaacgtaacgttccgaggaaacccggaccgacccggggtaccgtttagtaacgttaaccgttggtaacggcggaaggtaacggaggttaaaccgggggttaaatttacggttttcggacgtttaccgggttacccttggtttaacgaaccgttacgggtaccggggcccgtaacggggttaaccccgttccggg

SEQ ID NO: 391320 - DNA, 620 bp, Homo sapiens
  misc_feature: GZ8MTXP01EDKSS.39.81.H04.1.454.CMB.2.raw
  modified_base (387)..(387): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttatgatgactcagtctccagtctccctgccccgtcacccttggacagccggcctccatctcctgcaggtctagtcaaagcctagtatacattgataggaaacacttattagtaattggttcagcagacggccaggaccaatcctaccgaaggccgtaccttaaatttagttaacggtttccgtaacccgggtactcgtcggggtcccaagacagtacttcgagcggcaggtgggtacnggcaacgtagaattaccaactaactagaaaatcgaaggacgaggggtggaggtacgtaggaggtagttgggtttaggggtttattacgtagcgtagtacgaacgaaaggaacacgtacgtcggtacccttaccgtacgttacgtttcggaccggtaaggggaaccttaggcgttaggaacgtaacttaccgaaacggttacgtggtacggcgtacgaccttactgttcgttcg

SEQ ID NO: 391321 - DNA, 626 bp, Homo sapiens
  misc_feature: GZ8MTXP01C9VG7.39.81.H04.1.454.CMB.2.raw
  modified_base (190)..(190): a, c, t, g, unknown or other
  modified_base (274)..(274): a, c, t, g, unknown or other
  modified_base (351)..(351): a, c, t, g, unknown or other
  modified_base (469)..(469): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctgganctgagatgacgagcctggggcctcagtgaaggtctcctgcaaggcttctggttacacctttacaactatggtatcagttgggtncgacacggcccctggaacaagggctggagtggaatggggatggatcgagcgcttaacaatggtacaacaacaaactntcgccaaacagaaaccctccgaaaggggccaaggacgtaaaaccaccaagtcgaaacccacgaacgaaccaacaactaccaacggacgaccgaacgggaccctaacaacgtcggaccngaacggacgccgtagagaactcgacgaccgacgacggtaccgttgtaacttacgtggtggaacgaaggaggtacgttaggggtaaattacggttttagacgttacggttaaccccttagtttcgacgtacggttcgggaaccgaacggggtaacccg

SEQ ID NO: 391322 - DNA, 721 bp, Homo sapiens
  misc_feature: GZ8MTXP01AXJ1K.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatcagttgggtgcgacaggcccctggacaagggctgagtgatgggatggatcgagcgtcttacaatcggtacaacaacaaaactatcgacccaacagaaccctccgagggcaagaagtccaaaccgatacgacccaacgaacgaaccacactacccaacgacgaccaacgggacccttaacaacgtcgggaacccgtggaacgggacgtacccgttaggggaaacgtaagttacccgtacggaaacccggaacccgaaccggggtacccggtttaagttaacgtttaaccgtgggttacgggaccggtaaagggtaacggttaagggttaaaccgggggttaaaatttacgtttttacggaaccgtttccgggtttaaacccccgtttcgttttacggtaaccgtttaccgggtacggggggttaccccgtaacgggggttaaacccccgttccgggg

SEQ ID NO: 391323 - DNA, 574 bp, Homo sapiens
  misc_feature: GZ8MTXP01BN152.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaactatggtatcagttgggtgcgacaggcccctggacaagggcttgagtggatgggatggatcagcgcttacaatggtacacaacaaactatgaccacagaaccctccgagggacagaacgtcaccatcgaccacagacacactccacgagcacggcctacacgtcggacctgaggacgccgtggacgtatcgagaccgacgacggcgtagtacttacgtgtgcggaagagagtacggggttaaattagtttagacgttcggttacccttcgtttacggaacgttacggtcggggacccgtaacggggttaacccgtcggg

SEQ ID NO: 391324 - DNA, 596 bp, Homo sapiens
  misc_feature: GZ8MTXP01ATN8P.39.81.H04.1.454.CMB.2.raw
  modified_base (379)..(379): a, c, t, g, unknown or other
  modified_base (494)..(494): a, c, t, g, unknown or other
  modified_base (554)..(554): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttacaactatggtatcgaggttgggtgcgacgacggcccctggacaagggcttgagtggatgggatggatcagcgtacttacaagttggtacacaactaaactatgaccacagaacctcgagggcagntcaccatcgaccacagtacacacaccaagacgaccaccggacctaacagtacggacctgaggtacgcctagggacgagttcgagaaccgacgaccgggccgttagtacttacggnggtacgcggaaggagttaggtaaacgggttaattagtttacgacgttcggttaccctttnttacgcgtacgggtcgggttaccgtaacgggttaacccgtgg

SEQ ID NO: 391325 - DNA, 725 bp, Homo sapiens
  misc_feature: GZ8MTXP01C0NL5.39.81.H04.1.454.CMB.2.raw
  modified_base (277)..(277): a, c, t, g, unknown or other
tcagtcgcactagtcacgaccggtgctcgatttagtagtgtagattcgcggggacccaaaaaccacacccctccctgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacaactatggtatcagttggtgcgacnggccctggacgaaggcttgaggtggagtgggatggatcgagcgtcttacgaagttggtacaacaactaaaactagtagacccaacgaacgaacccgtacccgagggaaccaagaacggtaccaaaccaagtacgaacccaacgacgaccaactacacccgaacgacgacccaccgggaccttaacgacgtacgggacccgttaggaacggaaccgccgttaggggaacggtacgttcgtacgggaaccgtaaccggtaccgggtccggtttaaggttacgtttaaccgtgggtacgaaccgggtaaacgggaaggttaacgggtaacgggggttaaattttaaacggtttttacggaaccggtttcgggtttaaccccctttaagttttacgggtccgtttaaaccgggcgggggttacccgtaaccggggttaaccccggtttcggg

SEQ ID NO: 391326 - DNA, 552 bp, Homo sapiens
  misc_feature: GZ8MTXP01E0HI1.39.81.H04.1.454.CMB.2.raw
  modified_base (383)..(383): a, c, t, g, unknown or other
  modified_base (469)..(469): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaatggtcacacaaactatgccacagaacctccagggcagaagtcaccatgacccanacgacacatccaacgagccacggcctacatcggaccctgaggagcctggagatctgacgacacggccgtgtatactgtcgcgaagngagtacgggggaaattagtttgacgttcgggttacccttgtttagaactacgtgggggccctaacgggggttaacccttcggg

SEQ ID NO: 391327 - DNA, 582 bp, Homo sapiens
  misc_feature: GZ8MTXP01AXCRR.39.81.H04.1.454.CMB.2.raw
  modified_base (369)..(369): a, c, t, g, unknown or other
  modified_base (542)..(542): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactatgaccacagaacctcagggaccagngtcaccatacgaccacagacacataccaacgagcacggacctaacataggaccctgaacggacgcccgtggggaacgtagtacctacggaacccgacgaaccgggcccgttagtaacttacgtgtcgacggaagagagtacggggaaattagtttgacgttcggttacccttntttacgaactacggtcggggcctaacgggaacccgtcggg

SEQ ID NO: 391328 - DNA, 766 bp, Homo sapiens
  misc_feature: GZ8MTXP01AVACA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgtaggttgggtgcgacacggcccctggacaagggcttggaggtggagtgggatggatcgaggcgtactttaacaagttcggtaccaacgaaaccaaaactatacgaccccaaacaacggaaacccctccgaaggggaccaaggaacgtaccaacccgaatacggaacccaacgaacgaacccaacaacgtacccaacggacgaccgaacccgggtaccctaacgacgttaccgggaacccgttgggaaacgggacgtaccccgtaggggaacggtacgttccgtacgggaaacccggacccgtaaccgggtccgttaacggttaactttaacccggtggtacggaccgggaaagggtaaaggttacgggttaaaccgggggttaaaattttacggttttacgggaacccgttttccggggttaccccttaacgggttttacgaacccggttacgggtcgggggttaaccccgtaaccgggggttaaccccgttccgggg

SEQ ID NO: 391329 - DNA, 663 bp, Homo sapiens
  misc_feature: GZ8MTXP01EUDOV.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctcctgcaggtctagtcaaagcctcgtatacattgataggaaacacctacttgaattggttcagcagacggccaggaccaatcctaccaaggtccgtaccttaaaattttagtaaacggtttaccgtaaacccggggtacttcgtacgggggtacccaaggacaagtattcgaaggtccggacgtaaacggttcggggtccagggacctaacgttaggaaactttcgaactaactagaaaatcgaagcggaaggggtacggaaggcgttaggagggtagttaggggtttaggggtttaattacgtaggggtctaagttcggacgaaagggaaccacgtacgtacggtcccttaccggtaacttaccgtttcgggaaccggtaacggggaccaaagttcgtaggacgaacttacgaaaaccgtaagtgtaacggcacggactaaccgttaatccg

SEQ ID NO: 391330 - DNA, 652 bp, Homo sapiens
  misc_feature: GZ8MTXP01DKGSJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttaccaccttttaccaaacttatggtatcgtaggttgggtgcgacgacggcccctaggacaagggcttggagtggagtgggatggatcgagcgtacgttacgaagttcggtacaacaacaaaactatacgaccaacgaacgaaccctccgaagggacaagcgtaccaaaccatacgaacccaacgaacgaaccacacaccgaacgagaccgtacggaccctacgagtacggacctgggaacggacgtccgtagggacgtaacgttcgacggaaccgaccgtaccggtaccgttagttacttacgtggacgacggaagtaaggacggtaaagggttaaatttacgtttacgacgttcgttacccttgttactaacgtacggtccgggaccgtaaccggttaaccgtccgg

SEQ ID NO: 391331 - DNA, 664 bp, Homo sapiens
  misc_feature: GZ8MTXP01AD0XY.39.81.H04.1.454.CMB.2.raw
  modified_base (374)..(374): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctctgcaggtctagtcaaagcctcgtatacattgataggaaacactattgaatggttacagcagacgccaggccaatcacaagcactaattatacggttctaacgggactcgtcgggccagacagtactcgagcggcaggtagggcaagggccaagtgtaacttcaanaacgtaagaaaactcgaaggacgtaggggtaggaggacgtagggtaagggtagtttaggggtttaggggttttaattaccgttaggacggtaagttcggaacgtaaaacggggacctaacgtacgtacggtaccccttaccggttaacgttaccgttttcggggacccgtaaacgggggaacccttaaaggtccgttaagggaaacggtaaccttaaaccggaaaaccggttaacgtttcggggtacggtaaccgttaccggacccttaccgttaacgttccgttaaccg

SEQ ID NO: 391332 - DNA, 672 bp, Homo sapiens
  misc_feature: GZ8MTXP01D4X4J.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttacacctttacaatatggtatcgtagttggtgcgacgacggcccctaggacgaagggtcttaggaggtggagtgggagtggatcgagcgtacttacaagtcggtacaacaacaaactatacgacccacaacgaacccgtccgagggacaagcgtaccaaccaagtacgaacccaacgacgaaccacaactaccaacgacgaccgaaccggacctaacgacgtacggaacccgtaggacggtacgacccgtaggggaacgtacgtaccgtacggaaccgaccgaccggtaccgttagttaattaccgtgtacgcggaagtaaggacggttaaacggggttaaatttacggtttacgttaacgtttcgggttacccttcgtttacgtaacgttacgggtcggggacccgtaacgggttaacccgttaacgg

SEQ ID NO: 391333 - DNA, 662 bp, Homo sapiens
  misc_feature: GZ8MTXP01C5E8L.39.81.H04.1.454.CMB.2.raw
  modified_base (259)..(259): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacaccttacaactntggtatcaggttgggtgcgacacggcccctggacgaagggtcttggagtggagtggggatggatcagcgcttaacaagtggtacaacaacaaactagtacgaccaacgacgaaccctccgaaacggggcaaggaacgtaccaacccagtacgaaccaacgaaacgaccaacaccaccgaacgacgacccgaacggaccctaacgacgtacggaccgtaggaacgggacgaccggtggaacgtacgtaccgtacgaaccgaccgaccggtaccgtagttacgttacgtggtcggaacggaaggaggtaacgttaacgggggtaaatttagttttacgcgttaccgggttaaccctttcgttaacgtacgttacggttacggggtaacccgaacgggtaaccccg

SEQ ID NO: 391334 - DNA, 609 bp, Homo sapiens
  misc_feature: GZ8MTXP01A8NFO.39.81.H04.1.454.CMB.2.raw
  modified_base (278)..(278): a, c, t, g, unknown or other
  modified_base (525)..(525): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaactatggtatcgagttgggtncgacacggcccctggacaagggcttggagtggagtgggatggatcagcgacttacaagtggtacacaacaaactatgaccacacgaaccctccgagggacaagcgtaccaccatcgaaccacaagaaccacactacccgaacgacgaccgaaccgggaccccttaaacgacgttacgggaccctagggaacggtacgcccgttagggaaggtactacgtacgacgacgacggtccgtagtattacgngtagcgaagagagtacgggaaattgttcgacgttcgttacccttgttgaacgttacggtcgggaccgtaacgggaaccgttcgg

SEQ ID NO: 391335 - DNA, 690 bp, Homo sapiens
  misc_feature: GZ8MTXP01EE0BP.39.81.H04.1.454.CMB.2.raw
  modified_base (279)..(279): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaaccaactatggtatcgaggttgggngcgacgacggccccgtggacgaagggtcttggaggtaggagtgggatggatcgacgcgtacttaacgaagttcggtacaaacaaactaaaactgacgaccccaacgaacgtaaacccgtacgacgggaacacgaacgtaccaaacctacgacgaacccacgaaacgaaccaacaacgtacccaacggaacgtacccgacggtaccctaacgtaacggtaccggaaccgagggaacggaacgccgtaagggaacgtacgtacgacgaaccgaccgccgggttacgtagttacttacgtggcgaaggaagtaggttaaggtaacgggttaatttgttacgttacgttccgggttacccttgttaggaacccgttcggggaccgggttacgtaacccgggttaacccgtccggg

SEQ ID NO: 391336 - DNA, 555 bp, Homo sapiens
  misc_feature: GZ8MTXP01BQHVH.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtcagcagaggccaggccaatctaccaaggcaccttaatttataaggtttctaaccgggacttcgtcgggggtcccagacagattccaggcgcagtgggtacaggcactgaattcacactagaaatcagcgagggtggaggctaggaggtagttggttggggtttattacgtagcagtgacaaaggaacacacgtcggcctaccgtactacgtttcggaccgtaggggaaccaagcgtaggagtactaacgaaacgttacgttaggtggctcgaccaccttagtcttcgttcc

SEQ ID NO: 391337 - DNA, 569 bp, Homo sapiens
  misc_feature: GZ8MTXP01DTG6F.39.81.H04.1.454.CMB.2.raw
  modified_base (334)..(334): a, c, t, g, unknown or other
  modified_base (342)..(342): a, c, t, g, unknown or other
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcanacaaactntcgccacagaacctccgagggacagngtcaaccatcgaccacagacacatccacgagcacggacctacatcggacctgacggacgcctaggagatcgtacgacgacgacggccgtagttatacgtgtgcgaagagttaggtacggggttaaattagtttgacgttcggttacccttcgtttagaaccgttaacggtcggggacctaacggggttaaccccgttcggg

SEQ ID NO: 391338 - DNA, 625 bp, Homo sapiens
  misc_feature: GZ8MTXP01AGZ6O.39.81.H04.1.454.CMB.2.raw
  modified_base (377)..(377): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgtacttacaatggtacacaacaaactatcgaccacagaaccctccgagggacagngtcaccatcgaccacacgacacactccacgacgcacggacctacagtcgggacctaggacggaacgcccgtagggagtactcgtacggaccgaccggccggtaccggtagtaacttcgtaggtcggacggtaagaaggttacgggtaacggggttaaatttacggttttacgaccgtttcggttaccccttcgtttaggaaccgttacgggtcgggggacccgtaaccgggggttaaccccgttcggg

SEQ ID NO: 391339 - DNA, 693 bp, Homo sapiens
  misc_feature: GZ8MTXP01AGZGX.39.81.H04.1.454.CMB.2.raw
  modified_base (423)..(423): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaactatggtatcgaggttgggtgcgacgacggcccctggaacgaagggcttggaggtggagtgggatggatcgaggcgtacttaacaagttcggtacaacaacaaactatcgaccaacaacgaaccctccgaagggaccaagaacgtaccaacccatacgaaccanaacgaaccacacaccaacggacgccgaacggacctaacacgtacgggacccgtagggaaggacgtccgtaggggaacgtacgttccgaacggaaccgggaacccgtaaccggggtcccgtttaaggtttaacttaccggtaggttacggacggaaggtaacggttagggttaaacggggttaaaattttcggtttacgaccgtttcggttaccccttgtttacggtaacgtacgggtacggggaccgtaaccgggttaacccgttccggg

SEQ ID NO: 391340 - DNA, 537 bp, Homo sapiens
  misc_feature: GZ8MTXP01C5CWG.39.81.H04.1.454.CMB.2.raw
  modified_base (215)..(215): a, c, t, g, unknown or other
  modified_base (365)..(365): a, c, t, g, unknown or other
  modified_base (375)..(375): a, c, t, g, unknown or other
  modified_base (384)..(384): a, c, t, g, unknown or other
  modified_base (411)..(411): a, c, t, g, unknown or other
  modified_base (460)..(460): a, c, t, g, unknown or other
  modified_base (462)..(462): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctnagtgaaggtctcctgcaaggcttctggttacacctttacaactatggtatcagttggtgcgacaggcccctggacaagggcttgagtggatggatggatcagcgcttacaatggtcacaacaaactatgccacagaacctccagggcagngtcaaccatnaccaacaanacacacacacgacgacgacgactacanacgacgagaggacgcgaggagatcgagacgacgacgcgtacgtatatgngngaagagagtaggttaagtagttagttacgttcgttaccttcttgtaacgtacgtcggacggtaacggaaccgtcg

SEQ ID NO: 391341 - DNA, 601 bp, Homo sapiens
  misc_feature: GZ8MTXP01BLDOL.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatctccaaggcgacctaatttataaggtttctaaccggactcgtgggggtcccagacagattccgagcggcagtgggtacagggcactgaaattcacactagaaaatcagcgagggtggaaggctaggagggtagttggttggggttattacgtagtacgagttgacgtaaaggaacacgacgtcggccttaccgtactacgttttcggaccgtaagggggtaaccctaaaggccgttagggaacgtaacgtaacgaaaacggttacgttacgtaaggggtccttcgggacctaaccgttacttccgttaacgtttcccg

SEQ ID NO: 391342 - DNA, 781 bp, Homo sapiens
  misc_feature: GZ8MTXP01CMO9Y.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctcatctctgcaggtctagtcaaagcctgtatacattgatggaaacactacttgaattggttcagcagacggccaggccaaatcctaccaaggcgtaccttaaatttacgtaaggtttcctaaaccgggcttcgtcggggtacccagacagtattcgagcgacgtaagggtgggtccagggtccaacgttacggaaactttccgaaactaaacgttaacggtaaaaacttaccgaagggtaccggaagggggtacggggtaaggggtaccgttagggtaaggggttaaggtttaggggttttagggggtttttaacgttttaaccggttagggggttacgttaaaggtttaacgggtaaccgtaaaacgggtaaaccccgaacccgttaaccggttaccggggtacccccgtttacccggttaaacccgtttaaccggtttttacggggaaccccgggttaaacgggggaaacccgtaaacgggttaccggtaaaggggtaacgttaacgttaaaccgttaaaaccggtaaccgttagggtaacggtacgttacggacctaacccgttaacgtttcccg

SEQ ID NO: 391343 - DNA, 584 bp, Homo sapiens
  misc_feature: GZ8MTXP01EY7QD.39.81.H04.1.454.CMB.2.raw
  modified_base (238)..(238): a, c, t, g, unknown or other
  modified_base (280)..(280): a, c, t, g, unknown or other
  modified_base (346)..(346): a, c, t, g, unknown or other
  modified_base (372)..(372): a, c, t, g, unknown or other
  modified_base (386)..(386): a, c, t, g, unknown or other
  modified_base (394)..(394): a, c, t, g, unknown or other
  modified_base (400)..(400): a, c, t, g, unknown or other
  modified_base (408)..(408): a, c, t, g, unknown or other
  modified_base (416)..(416): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttntggttacacctttaccaactatggtatcagttgggtgcgacnggcccctggacaagggctgagtgatgggatggatcagcgtacttacaagtggtacaacacaaactntcgaccacagaacctcgagggacagngtcacatcgaccanagacacancacgancacgctanatcggacngagacgcctagggagactcgagacgaccgacgggtccgttaggtacttaaccgtggtacggacgaaggacgttaggtacgggttaaaattcgtttacgaacgttcggttacccttcttttagaaccgttacgggcggggttacccgtaacgggttaaccccgttcggg

SEQ ID NO: 391344 - DNA, 713 bp, Homo sapiens
  misc_feature: GZ8MTXP01A4K5W.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatcgtaggttgggtgcgacgacggcccctagggacaagggcttgaggtggagtgggatggatcgagcgtacttaacaagttcggtacaacaaactaaaacgtatacgacccaacgaacgaaaccctccgaaggggaccaaggtcgtaccaaaccgtataccgaacccaacgaacgaaccaacaactacccgaacggacgaccgacggtaccctaacgagtaccgggaacctggaacgggacgtacccgtagggggaacgtacgtaccgtacggaaccgaacccggtacggtcccgttaagttaacgttaccgtaggtcgacggaaagtaggttaaacggttacggggttaaatttacgttttacggaccgtttcgggttacccctttaacgtttggtaacccgttacgggtaccggggttacccgtaacggggttaaccccttaacgggg

SEQ ID NO: 391345 - DNA, 699 bp, Homo sapiens
  misc_feature: GZ8MTXP01A4XSK.39.81.H04.1.454.CMB.2.raw
  modified_base (240)..(240): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggtcttntggttactacctttacaactatggtatcgaggttgggtgcgacgacggccccctgggaaccgaagggtcttggaggtggagtggggatgggatcgagtcgtacttaacgaagttcggtacaacaactaaactataccgacaaacgaacgaaccccgtaccgaaaggggaccaaggaacgtaccaaacccgacgtacgaaccccaacgaacgaaccaaccaactacccgaacgaacgaccgaacccggtaccctaacgacgtacgggaacccgtagggaacgggtacgccgggtagaacggtactaccgtacggaacccgacgaccgggtccgttagttaacgttacgtggtcggaacggaaggaaggtaggttaacggggtaaatttcgttttacggcgttacggttaacccttcgttaacgtaccgtacggttacggggtcccgttaacggtaacccg

SEQ ID NO: 391346 - DNA, 592 bp, Homo sapiens
  misc_feature: GZ8MTXP01CFNGR.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctcatctcctgcaggtctagtacaaagcctgtatacattgataggaaacactactgaattggttcagcagacgccagcaatcacaaggctaccttaaatttataacggtttacaaccggctcgtcgggtacccagacagtacttgacgcggacaagggttgggcagggactaacgtgaacttcgacaactagaaaatcgaagcgagggtggaggactaggaggtagtggtttagggttattacgtagggctagtagaacgaaagtaacacgtacgtacggtccttaccgttacgtacgtttcgggaaccgtaagggaccgtaaagcgtaaggtagaacgttaacgaaacggtaacgtggtaacgggtctacggacctaaccttgttaaccg

SEQ ID NO: 391347 - DNA, 715 bp, Homo sapiens
  misc_feature: GZ8MTXP01DIJUR.39.81.H04.1.454.CMB.2.raw
  modified_base (124)..(124): a, c, t, g, unknown or other
  modified_base (273)..(273): a, c, t, g, unknown or other
  modified_base (277)..(277): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggancatcctttcttggtggcagcaacaacaggtgcccactccccaggttcagctggtacagtctggagctgagatgacgaagcctggggcctcgagtgaaggtctcctgcaaggcttctggttacacctttacaactatggtatcagttggncganaggcccctggacaagggcttgagtgatgggactggatcagcgacttacaagttggcctaacacgtaaactagtcgacccctaacgtacggaacccgttccgaaggggtaccctaaggtaacgttacccgaacccgtaacgttccgggtaaacccaccggtaacgtaacccgacgtaacgttaccccgtaaaccggacgtacccgtaaccgggtaccctaaaccgtacggttaccgggaaccccgttaggaacggtaacgtcccttaggggaacggtacttacgtacggaccgtaccgaacgggtcccgtaggtaacttaccgtgtacgcgtaaggagttacggtaccgggttaaattcgttttcgaacgtttcgggttaaccccttgttaggaaccttaacgggtcggggttacctaacggggttaacccttccgggg

SEQ ID NO: 391348 - DNA, 677 bp, Homo sapiens
  misc_feature: GZ8MTXP01BKCBZ.39.81.H04.1.454.CMB.2.raw
  modified_base (346)..(346): a, c, t, g, unknown or other
  modified_base (375)..(375): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttgggtgcgacaggcccctggacaagggcttgagtggatgggatggatcaggcgcttacaagtggtacacacaaactntcgccaacagaaccctccgagggaccagngtcaccatcgaaccacagacacactccaacgacgaccacggaccctaaacacgtacgggaccctagggacgggaacgcccgttagggggaacggtaacttaccggtacggaaaccggacccgaaccggggtacccggtttaggttaacgtttaaccggttggttacgaacgggaaaggtaagggttaaccgggttaacgggggttaaaatttagtttttacgggaaccgtttcgggttaacccctttcgtttacgtaaccgttaacggtcgggggaccctaacgggggttaaccccttcggg

SEQ ID NO: 391349 - DNA, 620 bp, Homo sapiens
  misc_feature: GZ8MTXP01A5EAY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacatcgcccctggacaagggcttgagtggatggggatgggatcgagcgcttaacaagtggtacaacaacaaactatcgacaacaacgaaccctccgaaagggccaagacgtcaaccatacgaccacagacacactaccaacgacgacaccggacctacacgtacggacctggacggacgccggtgagactacgtcgaaccggaccgaccgggtccgttagttacttacgtgtggaacggaaggacggtaaggttacgggggtaaatttagtttacggcgtttacggttaaccccttgtttaacgaccgttacggttacgggggtcccgaacggggtaaccccg

SEQ ID NO: 391350 - DNA, 722 bp, Homo sapiens
  misc_feature: GZ8MTXP01C8EBH.39.81.H04.1.454.CMB.2.raw
  modified_base (351)..(351): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacaactatggtatcagttgggtgcgacaggcccctggacaagggcttggagtggagtgggatggatcgagcgacttacaagttggacaacaactaaaactntcgacccacaacgaaccctccgaagggaccaagcgtacaacccaatacgaacccaacgaacgaaccacaactacccgaacgacgaccgaaccggacccttaacgacgttcgggaacccttagggaacggaccgcccgttaggggaacgtacgttaccgtacggaaccgaaccgtaccgggtcccgtttaagttacgtttaaccgtggtacggcggtaaaggtaaggttaacgggttaaccgggggttaaaattttacggtttttcggaaacccgttttccggtttaaaccccttttcggtttacggtaaccgtttaaccggggtaccgggggttaaccccgtaaccgggggttaaaccccgtttcccgggg

SEQ ID NO: 391351 - DNA, 505 bp, Homo sapiens
  misc_feature: GZ8MTXP01CK60P.39.81.H04.1.454.CMB.2.raw
  modified_base (193)..(193): a, c, t, g, unknown or other
  modified_base (259)..(259): a, c, t, g, unknown or other
  modified_base (265)..(265): a, c, t, g, unknown or other
  modified_base (274)..(274): a, c, t, g, unknown or other
  modified_base (279)..(279): a, c, t, g, unknown or other
  modified_base (287)..(287): a, c, t, g, unknown or other
  modified_base (298)..(298): a, c, t, g, unknown or other
  modified_base (375)..(375): a, c, t, g, unknown or other
  modified_base (399)..(399): a, c, t, g, unknown or other
  modified_base (491)..(491): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtgggatgttgtgatgactcagtctccagtctccctgcccgtcacccttggacngccgcctccatctctgcaggtctagtcaaagcctcgtatacattgatggaaacactatgaatgttnagcagngcagcatcncagcnctaattanagttcaacggntcgtggtccagcagacttcagcgcagtgggcaaggcaagtgaaattcaacactagaaaatcaagcgagggtggaagngtgaggtatggttgggttatatgnatagacaaggaacacacgtgacctcgtaactcgtttacggcgaaggggaccaaggtcgttaggagaacgttacgaaacgacgtaagtcggcncgacactgttcgtg

SEQ ID NO: 391352 - DNA, 693 bp, Homo sapiens
  misc_feature: GZ8MTXP01DWA8I.39.81.H04.1.454.CMB.2.raw
  modified_base (283)..(283): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttacaactatggtatcgaggttgggtgcgacncggcccctggacaagggcttggagtggagtgggatggatcgagcgtacttaacaagtcggtacaacaacaaaactatacgacccaacaacgaaccctccgagggacaagcgtaccaaacctatacgaacccaacgacgaacaactaacacccgaacgacgacctaacccgggacccttaacgagtacgggaacccgtaggaacgggaacgtcccgtaaggggaacgtactaccgacggaaaccgacgaccggtaccgttagttaaccttacgtaggtcgacggaaggtaaggttaacggtaaacggggttaaatttacgttttcggaaccgtttcgggttacccctttgtttacggaacccgtttaacgggcgggggttacccgtaaccggggttaaccccgtttccggg

SEQ ID NO: 391353 - DNA, 690 bp, Homo sapiens
  misc_feature: GZ8MTXP01CUV2N.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacaactatggtatcgtaggttgggtgcgacgacggcccctggacgaagggcttggaggtggagtgggatggatcgaggcgtactttacgaaagttcggtaccaaacgaactaaaacttagtacgaccccaaacgaacgaacccgtaccgaaggggaaccaaggtaacgtaccaaacccgtatacgaacccaacaacgacacgactaccacgagccgacggacctacagtcggacctggaaggacgcctaggggacgtaacgtcgtacggaccgaaccgtaccgggtccggttaagttacgttaaccgtggtacggacggaaaggtacgggttaagggttaaacgggggttaaatttacggtttacgaccgttcgggttacccctttgtttacggaaccgttacgggtccgggggaccgtaaccggggttaacccgtcggg

SEQ ID NO: 391354 - DNA, 739 bp, Homo sapiens
  misc_feature: GZ8MTXP01AEOF1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacacggcccctggacaagggcttgagtggagtgggatggatcagcgtcttacaatggtacacaacaaactatcgacccaacacgaaccctccgaggggaccaaggcgtccaaccatacgaaccacacgaaccacaactacccgaacggaacgaccgtaaccgggaccccttaacgaacgtacggggaacccttagggaacgggacgtacccgtaggggaacgtacttaccggtacggaaccggaccggtaccggggtacccggtttacggttaacgtttaccgtcgggttacggaccgggtaaaggtaagggttaacgggttaacggggggttaaaattttacggtttttacgggttaaccggtttccggggtttacccccgtttgttttaccggtaaccgtttaccggggtaccggggggttaccccgtaacggggggttaacccccgtttaaccggggg

SEQ ID NO: 391355 - DNA, 635 bp, Homo sapiens
  misc_feature: GZ8MTXP01A89N6.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcagcgtcttaacaattggtacacaacaaactatgaccaacagaaccctcgagggacagaacgtcaaccatcgaaccacagacacactaccacgacgcctaacggaccctaacagtacgggaccctggaaggacgcccgtaggggaacgtacgttccgtaggaaccgaccgacccgggtcccgttagttacgttaccgtggtcggcgaaggaacggttaggtaacgggggttaaatttagttttcgaacgtttcggttacccctttgtttcggaaccgtttacggcgggggttaccctaacggggttaaccccgttcggg

SEQ ID NO: 391356 - DNA, 735 bp, Homo sapiens
  misc_feature: GZ8MTXP01A2RFG.39.81.H04.1.454.CMB.2.raw
  modified_base (274)..(274): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaatatggtatcagttgggncgacaggcccctggacaagggcttgagtggatgggatggatcgaagcgtactttaacgaagttcgggtaccaactaacaaaacgttagtacgaccccgaacaaacggaaacccttcccggaagggggtacccaaggaacggttacccaaacccgaagttaccgggaaaccccaacgaaggaaaccctacgtaactaccccgaaacggacgaccgaaaccgggtcccctaaacgagtacggggaacccttagggaacgggacgcccgttagggaacggtaacttccgtacgggaaccggaaccgaacggggtcccggttaaggttacgttaaccgtggtacggccggtaaggacggttaggttaacggggaaatttagttttcggaacgttcggttaaccccgttgtttacgggaaccttacggggtcggggacccgtaacgggggttaaccccttccgggg

SEQ ID NO: 391357 - DNA, 630 bp, Homo sapiens
  misc_feature: GZ8MTXP01AOZKP.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgccccgtcacccttggacacgccggcctccatcctcctgcaggtctagtcaaagcctgtatacattgatggaaacctctattgaattggttacagcaggacggccaggccaatcctaccgaaggcctactttaaatttagtaacggttttccaaacccggggtacttccgtgggggtacccaggacaggtacttcgagcggacaggtcgggtcaaggcaacgtgtaattcaacgtactaagaaactcgagacggaggggtggaggtacgtaggaggtagttaggtttagggttaattacgtagtagagttagaacgtaacggaacaacgacgtacggacccttacggtaaccgtaccgtttcgggacccggtaaggggaacccgttaggtacgttaggacgtaacttacgaaacgttaacgtcggtaggcctacgacttactcttaacgttccg

SEQ ID NO: 391358 - DNA, 695 bp, Homo sapiens
  misc_feature: GZ8MTXP01EUR8R.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgagttgggtgcgacgacggcccctggacaagggcttgagtggagtgggatggatcgagcgtactttacaagttggtacaacgaacaaaactatgacccccaacaaacggaaaccctccgaaggggaccaaggaacgttacccaaacccaagtaccgaaaccccaacaacggaaccaaccaactacccgaacgacgacccgaaccgggtaccccttaacgaacgttacgggaacccgtagggaacgggaacgtcccgtaggggaacgtaacgtccgtacggaaccgaccgaccgggtccgttaggtacttactggtcgacgaaggaagttaggtacggggttaaattaggtttacgacgttccggttaacccgttgtttacggaaccgttacgggtcggggttacccgtaacggggttaacccgttccggg

SEQ ID NO: 391359 - DNA, 680 bp, Homo sapiens
  misc_feature: GZ8MTXP01CN1LK.39.81.H04.1.454.CMB.2.raw
  modified_base (351)..(351): a, c, t, g, unknown or other
  modified_base (377)..(377): a, c, t, g, unknown or other
  modified_base (393)..(393): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaaccaactatggtatcgagttgggtgcgacacggcccctggacgaagggcttaggagtggagtgggatggatcgagcgcttacaatggcacgacaaactntgaccacacgaacctccgagggcagngtcaaccatcgaccanagaccacactacccaacgacgacaccgggacctaacacgtcgggacctgggaaggtacgcccgttaggggacgtagtacctacgggaaccgaaccgaccgggtaccgttacggttaacgtttaccgtggtccggacgggaaaggtaacggaagggtttaaaccgggggaaaattttaaggtttttacggttaaccgtttccggggtttaaaccccctttgggttttacgtaaacgttacccgggttcggggggaacccctaacgggggttaaacccccgttccgggg

SEQ ID NO: 391360 - DNA, 557 bp, Homo sapiens
  misc_feature: GZ8MTXP01EAGCI.39.81.H04.1.454.CMB.2.raw
  modified_base (290)..(290): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatagaaacacctacttgaattggtcagcagagccaggccaatctacaagcnctaatttataagttcaacggctcgtgggaccagacagattccgagcggcgaggtggtcaggcactgaaacttcaacactaagaaaatcaagcgaggggtggagacgtaggagtagttggttagggtttatacgtgacagtagacgtaaaggaacacgaacgtcgccgttaccgtactacgtttcggccgtaaggggaaccaagcgtaggagacgttaacgaaacgttcgttaggtgggcttcggactaccttattccttgttaaccc

SEQ ID NO: 391361 - DNA, 629 bp, Homo sapiens
  misc_feature: GZ8MTXP01BZZS6.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttggagtggatgggatggatcgagcgcttacgaattggtcacacaaactatgaccacagaaccctcgaggacagcgtcaccatcgaccacagacacatccacgacgcacggacctacagtcggacctggaaggacgccgtagggacgtatccgtacgaaccggaccgaccgggtccggttagttaacttcgtggtcggcggtaaggtaacggttaacgggtacggggttaaatttacggttttcggaaccgtttcgggttaccccttcgttttacggtaaccgttacgggtcgggggttacccgtaaccgggggttaaccccgttccggg

SEQ ID NO: 391362 - DNA, 646 bp, Homo sapiens
  misc_feature: GZ8MTXP01AHRDJ.39.81.H04.1.454.CMB.2.raw
  modified_base (343)..(343): a, c, t, g, unknown or other
  modified_base (382)..(382): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacagacccctggacaagggcttgagtggatgggatggatcagcgtcttacaatggtcacacaaatntgccacagaacctcagggcagcgtcaaccatacgaccanacgacacactaccacgacgaccgacggaccttacacgtcgggaaccctggaaggacgcctaggggagtaactcgtacggaccggaacgaccgggtccgttacggttaatttaccgtgggtacgaccggaaggaacggttagggttaaccgggggttaaaatttacggttttcgaacccggtttcgggttaaccccccgtttgtttacgggaacccgtttacgggtacgggggaccccgtaacgggggttaaccccgttccgggg

SEQ ID NO: 391363 - DNA, 608 bp, Homo sapiens
  misc_feature: GZ8MTXP01AGKLZ.39.81.H04.1.454.CMB.2.raw
  modified_base (358)..(358): a, c, t, g, unknown or other
  modified_base (403)..(403): a, c, t, g, unknown or other
  modified_base (512)..(512): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgaggttgggtgcgacacggcccctggacgaagggcttggagtggagtggggatggatcgagcgcttaacaagtggtacacgaactaaactntcgaccaacagaaccctcgagggacagcgtacaccatacgaccanagaccacactaccacgagccgaccggacctacagtcggaccctaggacggacgccgtagggacgagtcgacgaaccgacgaccgggtccgttagtacttacgtgtacgnggaagagttaggtacggggttaaatttgtttacgcgttcggttaccccttgttgaaccgttcggtcgggggacctaacgggttaacccgttccggg

SEQ ID NO: 391364 - DNA, 730 bp, Homo sapiens
  misc_feature: GZ8MTXP01D4RVJ.39.81.H04.1.454.CMB.2.raw
  modified_base (261)..(261): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttgtgtacaccttacaactatggtacncgtaggtggtgacgacgaccggtccgtaggaacgaacggtcgtaggaggtaggagtagggtagtaggtacgtacggacgtcgtacgttaacgtaaggtacggtaacaaaccgtaaactaaacgttagacgaaccccgaacgaaaccgtaacccgacgggaacggaaccgaagtaaccggtacccaaaccgttaacgtacccgaacccgaacgtaaacgaaacccactaccaacccggaacgaccgtaaccgacccggtaaccctaagtacggaccggaccgtagggaacgtacccgtgtaagggaacgtaccgttcgaacggaccgtacccgtacgggttacgttaagttacctaggtgtacggacggtaagtaccggttaagggttaaacgttattttaacgcgttacggttccgttcctttaaggttcaacggtcggggacgttacggtaaccgttaacggttcccg

SEQ ID NO: 391365 - DNA, 706 bp, Homo sapiens
  misc_feature: GZ8MTXP01EBIIO.39.81.H04.1.454.CMB.2.raw
  modified_base (215)..(215): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctctgcagtcttctgttacacttacatatggtatcgagtggtgcgacacggccctggacaagggcttggagtggagtgggatggatcgaaggctacttaacgaagttcggtacaactaactaaaactgtacgacccaacgaaacgaaccctaccgaacggggtacaagaacgtaccaaacgataccgaaccaacgagaccaacactaccacggaacgacctaaccgggacctaacgacgttaccgggaacctagggaacggaacgtccccgttagggaacgggtactccgtaacggaacccggaaccgtacccgggtaccggtttaggtaacgtttaaccgtggttacggaccgggtaaagtacgggttaaaggggtaaacggggttaaatttaggttttacggacgttttaccggttaccctttggtttacgaaccgttacgggtcggggacctaaccgggggttaacccgtttaaccggg

SEQ ID NO: 391366 - DNA, 625 bp, Homo sapiens
  misc_feature: GZ8MTXP01EVKN6.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatagaaacacctacttgaattggtcagcagaggccaggccaatctaccaaggcaccttaaatttagtaaggtttctaaccgggactcgtggggtcccagacagattccagtcggcagtggggtacaagggcacgtgaaacttcaacactagaaaactcgagcgagggtggaggcgtaggaggtagttagggtttaggggtttaacttacgtgtacgtaaggttcggaacgtaaacgggaaccaaccgtacgtcgggtcccttaccgttaactaccgttttacgggaccggtaacggggaaccctaaaggcgttagggagaacgttaaccgaaaaacggttcgttacggttgggacctcggacctaccgttacttcgttcgtttccc

SEQ ID NO: 391367 - DNA, 651 bp, Homo sapiens
  misc_feature: GZ8MTXP01CEQO5.39.81.H04.1.454.CMB.2.raw
  modified_base (351)..(351): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaggcttctgttacaccttacactatggtatcgtaggttggtgcgacacggcccctaggacgaagggcttgaggtggagtgggatggatcgagtcgtcttacaagtggtacactaacaaactntacgaccacagaaccctcgaggacaagcgcacatacgaccacagacacacaccacgacgccgaccggacctacgacgtacggacccgtagggacggacgccgtagggaacgtacgtccgtacggaccgtaccgaccgggtaccgttacgtaacgttacgtgtacggacggtaaggaaggttaggttaacggggttaaagtttacgtttacgttaccgtttccggttacccctttggtttaccggtaaccgttaccggggtcggggttaccccgtaacggggttaaccccgttaaccgggg

SEQ ID NO: 391368 - DNA, 660 bp, Homo sapiens
  misc_feature: GZ8MTXP01C6GQP.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttaccaactatggtatctaggttgggtgcgacacggcccctggacgaagggtcttggaggtggagtgggatggatcgagcgtacttacgaaagttggtaccaacgaacaaaactatacgacccaacgacgaaccctcccgagggacaagcgtaccaacccatacgaccaacgagaccaccactaccgaacgacgaccgaaccggacctaacgacgttacggacccgtaggaaggacgacccgtaggggaacgtacgttaccgacggaccgaaccgaccggtccgttagtacttacgtgtcgacggaagtaaggttaggtaacggggttaaatttagtttcgttaccgttcggttacccttgtttacgaaccgttcgggacggggttacccgtaacgggttcccgttaaccgg

SEQ ID NO: 391369 - DNA, 589 bp, Homo sapiens
  misc_feature: GZ8MTXP01DEM97.39.81.H04.1.454.CMB.2.raw
  modified_base (349)..(349): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgactttacaagttggtacacacaaaactntcgaccacagaacctccgaggggaccagcgtcaaccatcgaccanagacacatccaacgagccacggacctacatcggacctgaggacgcctaggggagatcgtacggacgacgacgggtccgtagttacgtacctggtcgcggaagtagagtacgggggttaaatttagtttcgaacgttcggttacccttcgttagaacgttacggtcggggttaccgtaacggggaacccgttcggg

SEQ ID NO: 391370 - DNA, 660 bp, Homo sapiens
  misc_feature: GZ8MTXP01CUL7R.39.81.H04.1.454.CMB.2.raw
  modified_base (349)..(349): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctcgtatacattgatagaaacactacttgaattggtcagcagagccaggccaatctaccaggctactaatttataaggtttcaacggtctcgtcgggggtacccagacagattccaggcgngaggtgggtaacaggcactgaaattcacactagaaatcgagcgaggggtggaggcgtaggtagggtagttgggtttacggggtttattacgttgacgtaggttacggaacgtaaacgggaaccgtaacgtaaccgtcgggtacccgttacccggttaaccgttaccggtttttaccgggacccggtaaacgggggtaacccgtaaacgggttccgttacggggaaggtaaacgtaaccgttaaaaaccggttacgttcgggttaacggaccgtcggtaaccctaccgttacgtttccgttcggtttaaccc

SEQ ID NO: 391371 - DNA, 529 bp, Homo sapiens
  misc_feature: GZ8MTXP01AUVNR.39.81.H04.1.454.CMB.2.raw
  modified_base (248)..(248): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacncctattgaattggtcagcagagccaggccaatctacaagcaccttaatttataaggtttctaacggactcgtggggtacccagacagattcagcgcagtggtacaggcactgaattcacactagaaactcagcgagggtggagcgtagaggtatgggttacgggttatacgtgacaggtgacgaaaggacacgacgtcggcctaccgtactacgtttcggaccgtagggaaccaaggcgtaggagagtacaaacgagttcgaagctgcacagtcttcgttc

SEQ ID NO: 391372 - DNA, 674 bp, Homo sapiens
  misc_feature: GZ8MTXP01EMIEO.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctgttacacctttaccaactatggtatcgagttgggtgcgacacggcccctggacaagggcttgaggtggatgggatggatcgagcgacttacaagtggtacacaacaaactatcgacccaacacgaaaccctccgaaggggacaaggaacgtccaaccataccgaacccacgacgaaccacaactcccgaacgacgaccgaaccggacctaacgacgtacggaccgtggaacggacgtcccgtaggggacgtacgtacgtacgaaccgaaccgaccgggtaccgttagttaacgttaccgtaggttacggacggtaaaggaacggttaagggttaaacgggggttaaatttacggttttagttaccgttcggttacccgttcgtttacgtaacgttaccgggtcggggaccgtaaccggggttaacccgttcggg

SEQ ID NO: 391373 - DNA, 650 bp, Homo sapiens
  misc_feature: GZ8MTXP01EIV16.39.81.H04.1.454.CMB.2.raw
  modified_base (215)..(215): a, c, t, g, unknown or other
  modified_base (227)..(227): a, c, t, g, unknown or other
  modified_base (229)..(229): a, c, t, g, unknown or other
  modified_base (354)..(354): a, c, t, g, unknown or other
  modified_base (413)..(413): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaagtctcngnaggcttctgttactacctttacaatagtgtatctaggttggtgcgacgacggcccctggaaccgaaggtcttaggaggtggacgtgggatggatcagcgtactagaatggtacacaacaaactancgaccaacgtaacgaccctcgagggaaccaagcgtacacatcgaaccacgagacccaanacacgaacgacgaccgacgacctagacgacgacgacgacgacgcgtaggacgtacgtacgacggaccgtaaccgtaccggtacgttacgttaacgttacgttagacggaggtaaaggtaacggttaagggttaaacggttaaagtttacgtttaacgttaaccggtttccgttacccgtttaacgttacggaaccgttacgggaccgggttaccggtaacccgggttaacccgtccg

SEQ ID NO: 391374 - DNA, 686 bp, Homo sapiens
  misc_feature: GZ8MTXP01D9XZG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaactatggtatctaggttgggtgcgacacggcccctaggacgaagggcttggagtggatgggatggatcgagcgtacttaacaagttggtacaacaacaaactatgacccaacaacgaaccctccgaaggggacaaggcgtccaaccatacgaacccaacgacgaaaccacactaccgaacgacgaccaaccggaccctaacacgtacggaacccgtaggaacgggacgtaccgtaggggaacgtaacgttaccgtacggaaccggaaccgaccgggtacccggttagttaacgttaaccgtggtcggacgggaaaggaaggttaagggttaacgggggttaaaatttagtttacggttacgttcgggttacccttcgtttacgtaacgttacggtcgggggaccgtaacggggttaaccccgttcggg

SEQ ID NO: 391375 - DNA, 772 bp, Homo sapiens
  misc_feature: GZ8MTXP01A24PJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcaaggtcttcgtaggttaacctacctttaaccaacttagtgggttatcgtaggttggggtcgaccggacgacgggcccccgtaggacgaagggtcttggaggtggagtgggatggatcgagcgtacttaacgaagttcggtaccaactaaacgtaaaactgtacgaccccaacgaacggtaaaccctccggaaggggaaccaaggtaacgtaccaaacccgtagtaccgaacccaacgaacggaacccaacgtaacgtacccgaacgggaacgacccggtaaccgggtaccccttaacgacgttacggggaaccctagggaaccgggacgtacccttagggggaacgtacgttaccgacggaaaccggtacgcccgggttacgttagttacgttaccgtggtacggcggaaaggtaacggttagggtaaaccgggttaaattttaacggttcgttaaccggttccggttaacccttcgggttaacgaacccggttaccgggtcggggttacccgtaacgggttaaccccgttaaccgggg

SEQ ID NO: 391376 - DNA, 557 bp, Homo sapiens
  misc_feature: GZ8MTXP01CA9H5.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactatgaccacagaacctcaggacagngtcaaccatcgaccacagacacactccacgagacacggacctacatcgacctgaggacgccgtggacgatctagaccgacgacgcgtagtacttacgtgtcgcgaaggagagtacggggaaattagtttgacgttcggttacccttcgtttagaactacgtcggggacctaacggggttaacccgttcgg

SEQ ID NO: 391377 - DNA, 611 bp, Homo sapiens
  misc_feature: GZ8MTXP01BYWKO.39.81.H04.1.454.CMB.2.raw
  modified_base (286)..(286): a, c, t, g, unknown or other
  modified_base (363)..(363): a, c, t, g, unknown or other
  modified_base (385)..(385): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatcctcctgcaggtctagtcaaagcctacgtatacattgataggaaacacttatgaatgttcagcagagccaggccaatcnccgaaggctactaatttagtaaggtttcgtaacccgggctcggtgggtacccagacagacttcagcgcaggtgggcnggcactagaacttcaacactanaaaatcgaggtcgaggggtggaggcgtaggtaggtagttgggtttagggtttatacgtgacgtagtaggacgaaacgggaacacgtaccgtcggtcccgttaccgttacttaacggtttcgggaacccggtaacggggaaccaagggcgttaagggacgtaacgttaaccgaaaaccggttacgtggtacgggtaacctacggccaacgttaacgttcgtttaacg

SEQ ID NO: 391378 - DNA, 635 bp, Homo sapiens
  misc_feature: GZ8MTXP01BV6SB.39.81.H04.1.454.CMB.2.raw
  modified_base (249)..(249): a, c, t, g, unknown or other
  modified_base (358)..(358): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaacnctatgaatggttcagcagaggccaggccaatctaccaaggcgtacctaatttataaggtttctaaccgggactcgtgggtcccagacagacttcagcgcaggtgggtcnggcacgtgaattcacactagaaatcgagcgagggtggaaggctagggaggtagttgggtttaggggtttaattacgtggtacgtagtggtacgaaagggaaacctacgaccgttcgggtacccgttaccggttaaccgttacggttttaccgggacccggtaacgggggtaaccaacgggtaccgttaggggaaacgtaacgttaaccggttaaaaccggttacggttaagggtacgggtaaccttacgggacccgttaacctaacgttccgtttcg

SEQ ID NO: 391379 - DNA, 676 bp, Homo sapiens
  misc_feature: GZ8MTXP01EZ7FI.39.81.H04.1.454.CMB.2.raw
  modified_base (274)..(274): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttacaccttaccaactatggtatcgagttgggngcgacgacggcccctaggacgaagggtcttggaggtggagtgggatggatcgagcgtacttacgaagtcggtacaacaactaaaactatcgacccaacacgaaccctcgagggaacaagaacgtcaaccatacgaaccacagaccactacaccaacgacgaccgaccggacctaacgacgtacgggacccgtaggaacggacgtacccgtaggggacgtacgtcgtacggaaccgtaccgaaccggtccgttagttaacgttacgtgtacggacggaaggtaaggttacggtaacggggttaaatttacgttttaggttaccgtttccggttaacccctttgtttacggtaaccgtttacgggtaccggggttacccgtaaccggggttaacccgttccggg

SEQ ID NO: 391380 - DNA, 667 bp, Homo sapiens
  misc_feature: GZ8MTXP01DUOPB.39.81.H04.1.454.CMB.2.raw
  modified_base (237)..(237): a, c, t, g, unknown or other
  modified_base (269)..(269): a, c, t, g, unknown or other
  modified_base (274)..(274): a, c, t, g, unknown or other
  modified_base (353)..(353): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcagtgaagtctctgcaggcttntgttacaccttacaatatggtatcagttggtncgacncggccctggacaagggtcttggagtggagtgggatggatcgagcgtacttaacaagttcggtacaacaaactaaaactntacgacccaacaacgaaccctccgaagggaaccaagaacgtccaaacgatcgaaccaacaacgtaacacactacccgaacggacgaccgtaaccggaccctaacgtacgtacggggaacctagggaacgggacgccgtaggggaacgtataccgtaggaaccgaccgacgggtaccgttagttacgttacgtggtacggcggaaaggtaaggacggttaaacggggttaaatttacgttttcgaccgtttacggttacccctttaagttacgaaccgttacgggacggggaccgtaaccgggttaaccgttcgg

SEQ ID NO: 391381 - DNA, 654 bp, Homo sapiens
  misc_feature: GZ8MTXP01AOVYU.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaactatggtatcagttgggtgcgacaggcccctggacaagggcttgagtggatgggatggatcgagcgacttacaagtcggtacacaacaaactatcgaccacacgaaccctccgagggacagcgtcaccatcgaaccacaagaccacactacccaacgacgaccgacggaccctaacacgtcggaacccgtggaacggaacgtcccgtaggggaacgtacgtccgtacggaacccgaccgaccgggtcccgttagttaacgttaccgtgggtcggaccggaaggaaggttaacggttaacgggggttaaatttacgtttcggaacgttccgggttacccttcgttttacggaaccgttaccgggtcgggggaccctaacgggggttaaaccccttccggg

SEQ ID NO: 391382 - DNA, 570 bp, Homo sapiens
  misc_feature: GZ8MTXP01A9QRE.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggttcagcagaggccaggccaatctccaaggcgactaatttataaggtttactaaccggggggactcgtgggtccagacagattccagcggcgaggtgggtacaggcactgaattcacactagaaatcagcgagggtggaggcgtaggaggtagttggtttaggggtttattacgtgacgtagtaggacgaaaggaacacgacgtcggtccttaccgtacgtacgtttacggaccgtaaggggaaccaagcgtaggagtaacgtaacgaaacgacgttggtggcgtaacgctaccgttatcgttcgttcc

SEQ ID NO: 391383 - DNA, 568 bp, Homo sapiens
  misc_feature: GZ8MTXP01B4F8O.39.81.H04.1.454.CMB.2.raw
  modified_base (351)..(351): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatagaaacacctattgaattggttcagcagagccaggccaatctccaaggcgtacctaatttataaggtttctaaccgggactcgtggggtcccagacagattccaggcgngagtggtacaggcatgaattcacactagaaaatcagcgagggtggaggcgtaggaggtagttgggtttaggggtttattacgtgactaggtagacgaaaggaacacgtacgtcggcccttaccgtactacgtttcggaccgtaaggggaaccaaggcgtaggagtaacgtaacgaaacgacttggtaaggccgtaagcaccttattccgttcgttcc

SEQ ID NO: 391384 - DNA, 607 bp, Homo sapiens
  misc_feature: GZ8MTXP01CHEKM.39.81.H04.1.454.CMB.2.raw
  modified_base (600)..(600): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtccaggatccagtggggatgttgtgatgactcagtctccagtctcctgcccgtcacccttggacagccgcctcatctcctgcaggtctagtcaaagcctcgtatacattgataggaaacactattgaattggttcagacagacggccaggccaaatctaccaaggctaccttaaatttacgtaaaggttttccaaaccgggactcgtcggggtacccaagaccagtacttcgaggcggcaaagggttgggtcaagggcaacgtgaaacttcgaacaactagaaaactcgaaggcgtagggtaggaggtcgtaggaggtagttggtttagggtttattacgtggactaagtgaacgaaaggaacacgacgtcggacctaccgtacgtacgtttggaaccgtaggggaaccaaggcgtaaggaacgttaacgttaacgaaacggtaacgtggtcggctacgactaacccgttnttaaccg

SEQ ID NO: 391385 - DNA, 639 bp, Homo sapiens
  misc_feature: GZ8MTXP01A6ZS0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttggagtggagtgggatggatcgagcgctttaacaagttcggtacaacaacaaactatgacccacacgaaccctccgagggaccagaacgtcaccatcgaccacagaacacactacccaacggacgaccaccggaccctaacgagtacgggaaccctgggaacgggacgtcccgtaggggacgtacgttcgaggaaccgaaccgaccgggtccgttagtaacttaccgtggtcgacggaagaacggttaggtaacggggttaaattagtttcgacgtttcggttacccttgtttacgaaccgtttcggcggggttacctaaccggggttaacccgtccgg

SEQ ID NO: 391386 - DNA, 671 bp, Homo sapiens
  misc_feature: GZ8MTXP01EOFCG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatgtatcagttgggtgcgacaggcccctggacaagggcttgagtggagtgggatggatcagcgtctacaatggtcacaacaaactatgacccaacagaaacccgtcccgaagggacccaagaacggtacaacccaactcgaacccacgaacgaactaaccaactacccaacggaagaccaacccgggtacctaaccgtagtacgggaccctaggagggaacgccgttaggggaagtacgtacgttcggaaccggtaaccaccgggtacgtacggttatttaaccgtggtacgcggaagaggttacggtaggggttaaattcgttttaaggttaccgttgggttaccccctttgttaccgtaaccgttaacgggtcggggttaccccgtaacgggggttaaccccgtttcggg

SEQ ID NO: 391387 - DNA, 662 bp, Homo sapiens
  misc_feature: GZ8MTXP01DGEA4.39.81.H04.1.454.CMB.2.raw
  modified_base (351)..(351): a, c, t, g, unknown or other
  modified_base (615)..(615): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacactatggtatcagttgggtgcgacacggcccctggacaagggcttggagtggatgggatggatcgagcgacttacaagttcggacaacaacaaaactntacgacccaacaaacgtaaccctccgaaggggaccaaggtaacgtaccaaacccaagtacgaaccccgaacaacgaaccaacacgtacccgaacggacgaccgaaacccgggaccttaacgaacgtacgggaaccctagggaagggacgtcccgtaggggaacgtatacgtacggaaccgaaccgaccgggtcgttagtacttacgtgtacggcgaaggacgttaggtacgggttaaatttgtttcgacgttcgttaacccttnttaggaaccgttacgggcgggttaccgtaacgggttaacccgttcgg

SEQ ID NO: 391388 - DNA, 651 bp, Homo sapiens
  misc_feature: GZ8MTXP01BMXJD.39.81.H04.1.454.CMB.2.raw
  modified_base (213)..(213): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcggctggtacagtctggagctgagatgacgaagcctgggcctnagtgaaggtctctgcaagcttctggttacacctttacaactatggtatcagttgggtgcgacaggcccctggacaaggcttggagtggatgggatggatcgagcgactttacaagtggtacacgaacaaatatgacaacacgaacctcgaagggcaaagacgtcacatcgaaccacagacacatccaacgacgcgaacggcctaacacgtaggaacccgtggaacggacgacccttaggaacggggtaaacttcggtaacgaacccggtaaccgaacccggggtccgttaggttaacgtttaaccgtggtacggtacggaagaaggtaacggttaagggggtaaatttcggtttacgtacgttacggttcccttcgtttaaggacccgttaacggtcgggggacccgttaacggggtaacccgttcggggtaaccccg

SEQ ID NO: 391389 - DNA, 530 bp, Homo sapiens
  misc_feature: GZ8MTXP01BFH92.39.81.H04.1.454.CMB.2.raw
  modified_base (349)..(349): a, c, t, g, unknown or other
  modified_base (511)..(511): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggtcagcagagccaggccaatctcaaggcgacttaatttataaggtttctaaccggactcgtggggtcccagacagattccaggcgnagtgggtacaggcactgaattcacactagaaaatcagcgagggtggaggcgtaggaggtagttggttaggggttatacgtgcagtgacgaaaggaacacacgtggcctaccgtactacgtttaggccgtaggggaacaagcgtggagactacaaacgcttgngctgacacatcgttgttcc

SEQ ID NO: 391390 - DNA, 649 bp, Homo sapiens
  misc_feature: GZ8MTXP01BO0AR.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttaccacctttaccaactatggtatcgtaggttgggtgcgacgacggcccctaggacaagggtcttaggagtggagtgggatggatcgagcgtacttacaagttcggtacacgaactaaacgtatgacccacgaacgtaaccctcgagggacaggaagtccaaccatacgacccaacgacgtaccaacacacccgaacgacgaccgaccgggtaccctaacgacgtacgggaccctagggacggaacgccgtagggaacgtataccgacgaaccgaccgccggtacgtagttaactcgtgcgacggaaggtagaggtaacgggttaaattacggtttacgacgttcggttacccttgtttacgaacgtttcgggacggggaccctaacggggttaaccccgttcggg

SEQ ID NO: 391391 - DNA, 637 bp, Homo sapiens
  misc_feature: GZ8MTXP01AMMV4.39.81.H04.1.454.CMB.2.raw
  modified_base (624)..(624): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctccatctcctgcaggtctagtcaaagcctacgtatactattgatacggaaacaccttacttgaatttggtacagcaggacggccaggccaagtcctaccgaaagggtcctacctttaaatttaacgttaacgggttttacctaaacccgggtacttccggtacgggggtaccccaagacagtacgttacccgaggcggtacgtaggtcggggtaccagggctacgtagaacttcaactacgtaagaaactcgaggacgtaggggtaggaggtcgtaggaggtagttaggtttacggggtttatacgtgtacgaggtgaacgaaacggaacacgacgtcgtacctaccgttacgtcgtttacggaccgtagggaaccaaggcgtaggacgacgtaacgaaacgttcgttgtggactcgactacgntccgttaagttcc

SEQ ID NO: 391392 - DNA, 727 bp, Homo sapiens
  misc_feature: GZ8MTXP01B1U0L.39.81.H04.1.454.CMB.2.raw
  modified_base (282)..(282): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctgttactacctttaccaatatgtatcgtagttggtgcgacncggccctggacaagggtcttggagtggagtgggatggatcgagcgtactttaacaagttggtaccaaactaaccgtaaaacttagtacgaacccaaaccgaaacgtaaacccccgtccggaaaggggaacccaaacgggtaacggtacccaaacccgtaacgtaccggaaccccaaacgaacgaaaccaacacgtacccgaacggacgacccgaacccggacccttaacgagtccggaccgtaggaacggtacgaccgtagggacgtacgtacgacgaaccgcgaccggtccggttagttacgttacgtaggtcggacggaaaggtacggttaacggttaacggggttaaattttagtttacggaccgtttcgggtttacccctttgggtttcgtaaccggttacgggtaccgggacccggtaaaccgggttaacccgttcccgg

SEQ ID NO: 391393 - DNA, 585 bp, Homo sapiens
  misc_feature: GZ8MTXP01BG9C7.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgaccacagaaccctccgagggcagcgtcaccatcgaccacagaacacatccacgagacgacggacctacatcgggacctagaggacgcccgtagggacgtaactcgtacggaaccgacgtaccgggccgtaggttaattaccgtgtcgcgaaggacgagtacggggaaattagtttgacgttcggttacccttctttagaaccgttacggtcggggttaccctaacggggaacccttcggg

SEQ ID NO: 391394 - DNA, 750 bp, Homo sapiens
  misc_feature: GZ8MTXP01ALNPU.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctggttacctaccttaccaactatggtatcgagttgggtgcgacacggccctggacaagggtctgagtggagtgggtatggatcgaggcgtacttaacaagttcggtaccaactaaactaaaactacgtacgaccccaacgaacgaaaccctacccggaagggaaccaagtaacgtaccaacccgataccgaaccaacgaacgtaaccacactaccgaacggacgaccgaaccggtaccctaacgacgtaccgggacccgtaggaacggaccgccgtagggaacgtagttaccgacgaaccggaacccgtacccgggtaccgttaagttacgttaccgtggtggaaccggtaagggtaaagggttaacgggttaaacgggggttaaactttttaaggttttaacggttaacccggttttcccgggttaacccccttttaaggttttaccggaacccgtttaaccggggtccggggttaccccgttaagggttaaccccggtaaccccggg

SEQ ID NO: 391395 - DNA, 601 bp, Homo sapiens
  misc_feature: GZ8MTXP01DZE4N.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatcagttgggtgcgacaggcccctggacaagggcttgagtggatggggatggatcgaagcgactttaacaattggtcaacgaacaaaactatgaccacagaaaccctccgaaggggaccaagaacgtccaaaccatcgaacccacaagaccacactaccacgagcacggaccctaacatcggacctgaggagcctagggagtatctaggacgacgacggccgttagtacttacgtgtgcgaaggagagtacggggaaattagttttgacgttcgggttaccccttcgtttacgaacgttaccggtggggacccgtaacggggttaacccgttaacggg

SEQ ID NO: 391396 - DNA, 679 bp, Homo sapiens
  misc_feature: GZ8MTXP01CIYOR.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgaggttgggtgcgacacggcccctggacgaagggcttggaggtggagtgggatggatcgagcgacttaacaagttcggtaccaaccaacaaaactgtcgaccccacaacgaaccctccgaaggggccaaggcgtaccaaacccgatacggaaccccaacgaacgaaccaccactacccgaacggacgaccgaacccggaccctaaccgacgttaccgggaacccttagggaacgggacgtacccgtagggggaacgtaacgttccgtacggaaccggaccgtaccgggtcccgttagttacttacgtggtcgcggaaggaaggttaggtacggggttaaatttagtttcgacgttcggttaccccttgtttcgtaacgtacggtcggggacccgtaacgggttccccgttcgg

SEQ ID NO: 391397 - DNA, 706 bp, Homo sapiens
  misc_feature: GZ8MTXP01CHYRH.39.81.H04.1.454.CMB.2.raw
  modified_base (362)..(362): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaggtcttctgttacacctttacaatatggtatcgaggttggtgcgacgacggcccctggacgaagggtcttgaggtggagtgggagtggatcgagtcgtacttaacaagttcggtacaacaactaaaactntacgacccaacgaacgaacccgtccgaagggaccaagcgtaccaaccgagtacgaacccaacgacgaaccactacaccgacgacgaccgaccggacctaacgacgtacggaaccgtagggaacggacgaccgtagggaacgtacgttaccgacggaaccgtaaccgtaccggtacccgttagttaacgttaccgtggtacggacggtaaggtaaggttaacggttaaacggggttaaattttacggtttacggttaaccgtttccggtttaccccgtttaacgtttacggtaaccgttaccgggtcggggttaacccgtaaccggggttaacccgttaaccggg

SEQ ID NO: 391398 - DNA, 601 bp, Homo sapiens
  misc_feature: GZ8MTXP01AB6O0.39.81.H04.1.454.CMB.2.raw
  modified_base (275)..(275): a, c, t, g, unknown or other
  modified_base (349)..(349): a, c, t, g, unknown or other
  modified_base (398)..(398): a, c, t, g, unknown or other
  modified_base (445)..(445): a, c, t, g, unknown or other
  modified_base (462)..(462): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggagtgggatggatcgagcgtcttacagtggtacacaacaaactgngccacacgaaccctccgaggggaccagaacgtcaacccgatacgaccanacgaacacgactcccagagccacggcctacatcggacctggaacggngccgtggagtacgttcncggaacgcgaccgggccgttagtacttacgtggtacgcgtaaggagagtacggggaaattacgtttcgaacgtttccggttacccctttgttccgtaacgtaaccggtgggggaccctaagggggttaaccccttcggg

SEQ ID NO: 391399 - DNA, 661 bp, Homo sapiens
  misc_feature: GZ8MTXP01DI6IM.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgcttaacaattggtacaacaacaaaactatcgacccaacacgaaccctccgaaggggaccaaggaacgtcaacccatacgaccacagacacatccacgagcacggacctacagtcggacctggacggacgccgtaggggaacgtagttccgtacggaaccgaaccgaccggggtaccgtttaaggttaactttaaccgtggtacggacggtaaggaaggttaacggttacgggggttaaaattttacggttttcggaaccgtttcgggtttaacccctttcgttttacggaaccgtttacgggtcgggggttacccgtaacgggggttaaccccgttcggg

SEQ ID NO: 391400 - DNA, 679 bp, Homo sapiens
  misc_feature: GZ8MTXP01CFCDJ.39.81.H04.1.454.CMB.2.raw
  modified_base (343)..(343): a, c, t, g, unknown or other
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgacccacagaacctcgagggcagngtcaaccatacgaccacagactacataccaacgacgaccgacggacccttaacgacgttcgggaacccttaggaacgggacgacccgttaggggaacggtaacgttccgtacggaaccggtaaccgaaccggggtccccgttaggttaactttaaccgtgggttacggccgggaaaggtaggttaacggtaaccgggggttaaaattttacggtttttacggaaaccgtttccgggttaaacccctttcgttttacggaacccgtttacgggtcgggggaaccctaacgggggttaacccccgtttcgggg

SEQ ID NO: 391401 - DNA, 613 bp, Homo sapiens
  misc_feature: GZ8MTXP01A9SI1.39.81.H04.1.454.CMB.2.raw
  modified_base (348)..(348): a, c, t, g, unknown or other
  modified_base (511)..(511): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacaactatggtatcgaggttgggtgcgacacggcccctggacaagggcttggagtggatgggatggatcgagcgcttacaatggtacacacaaactntgaccacacgaacctccgaggacagcgtcaaccatcgaccaacagaacacactaccaacgacgccgacggaccctaacgacgtcgggaaccgtaggaacgggacgtcccgtaggggaacgtacgttcgacggaaccgacgaccggtccggttagtacttacgngtcgcgaaggaagttaggtacggggttaaattagttttaggacgtttcggttaaccctttgttgtaacgtacggtcggggacctaacgggttaacccgtcgg

SEQ ID NO: 391402 - DNA, 579 bp, Homo sapiens
  misc_feature: GZ8MTXP01CM1VE.39.81.H04.1.454.CMB.2.raw
  modified_base (247)..(247): a, c, t, g, unknown or other
  modified_base (277)..(277): a, c, t, g, unknown or other
  modified_base (282)..(282): a, c, t, g, unknown or other
  modified_base (289)..(289): a, c, t, g, unknown or other
  modified_base (299)..(299): a, c, t, g, unknown or other
  modified_base (301)..(301): a, c, t, g, unknown or other
  modified_base (312)..(312): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaaacncctactgaattggtcagcagagcagcatcncagcnctattanagttcacggntngggtccagacngattccaggcgcagtggtacaggcactgaattcacactagaaatcagcgagggtggaggcgtaggtagggtattggtttaggggtttattaacgtgacgtaggttggacgaaggaaacacgaaccgtggtacccgtaccgttacctacgtttttacggccgtaacggggaaccgtaaacggccgttagggaagtaacgttaacgaaaaccggttaaccgttaggttggccgttaacggacacccgttattccgttaacggtttcccg

SEQ ID NO: 391403 - DNA, 737 bp, Homo sapiens
  misc_feature: GZ8MTXP01EYX04.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacaactatggtatcagttgggtgcgacaggcccctggacaagggcttgagtggatgggatggatcagcgcttacaatggtacaacaacaaaactatgacccaacaagaaaccctccgaaggggaccaagaacgtccaaacccatacgaaccaacacgaacaacatcccaacgacgccgacggaccctaacgagtacgggaacctggaacggaacgcccgtaggggaacgtaaacttccgtaacgggaaccgaaacccgaacccggggtacccggttaaggttaaactttaaccgttggtacgggaccgggtaaagggaacggttaaacgggtttaaacggggggttaaaaaattttaggttttttaacgggaaaaccccgttttcgggggttaaaaccccccttttgttttacgggtaaccccgtttaacgggttaccgggggggaacccctaaaccggggggggttaaaaccccccctttcggggg

SEQ ID NO: 391404 - DNA, 667 bp, Homo sapiens
  misc_feature: GZ8MTXP01C4G0P.39.81.H04.1.454.CMB.2.raw
  modified_base (323)..(323): a, c, t, g, unknown or other
  modified_base (345)..(345): a, c, t, g, unknown or other
  modified_base (397)..(397): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaagtcttctgttacacctttacactatggtatcagttggtgcgacacggccctggacaagggcttgagtgagtggatggatcagcgtacttanaagttggtacacaactaaactntagacccaacaagaaccctccgaggaccaagcgtccaacctatcgaacccanacgacacactaccacgacaccgtacggacctacgagtacggacctggacggtaacgcccgtaggggaacgacgttaccgtacggaacccgaaccgtaccggggtccgttaacggttaactttacgtcgggtaggaccggaaggtaggttaaacgggttaacgggggttaaaatttacggttttacgaaccgttcgggtttaaccccttggtttacgaacccgttacgggtaccgggggttaccctaacgggggttaacccgtttccgggg

SEQ ID NO: 391405 - DNA, 546 bp, Homo sapiens
  misc_feature: GZ8MTXP01A2W5Q.39.81.H04.1.454.CMB.2.raw
  modified_base (525)..(525): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagctcgtatacattgatggaaacactacttgaatggttcagcagagccaggccaatctacaaggcgaccttaaatttagtaaggtttactaacccgggactcgtcgggggtacccagacacgaacttcgaggcggcaggtgggtcaaggcaactgaaacttcaacactagaaatcagcgagggtgagcgtggagtgtaggttggggttatacttgcagtgacaaggaacacgacgtcgacctcgtactacgtttcggccgtaagggaccaaggcgttggaagtacttacgaaacgagtgnggctgcacctaagttcgttcg

SEQ ID NO: 391406 - DNA, 635 bp, Homo sapiens
  misc_feature: GZ8MTXP01DG8DA.39.81.H04.1.454.CMB.2.raw
  modified_base (347)..(347): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaatatggtatcagttgggtgcgacaggcccctggacaagggcttggagtggatgggatggatcagcgcttacaagttcggtcaacacaaaactntacgacccaacacgaaaccctccgaaggggaccaaggaacgtaccaaacccaagtacgaacccaacgaagaaccaacaactccaaacgacgccaacggacctaacagtcggaacctggaacggacgcccgtaggggaacgtacgttacgacgaaccgaccgacggcccgttagtacttacgtgtcgcggaagagttagtacggggttaaaatttagtttcgacgttcggttaccctttgttacggaaccgttacggtcgggggaccctaacggggaaccccgttcggg

SEQ ID NO: 391407 - DNA, 713 bp, Homo sapiens
  misc_feature: GZ8MTXP01DULOY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggtactacctttaccaactatggtatcgtagttgggtgcgacgacggcccctggacgaagggtcttggaggtggagtggggatggatcgagcgactttacgaagttggtacaacaacaaactatacgaccacaacgaaccctccgagggaccaaggaacgtaccaacccagtacgaacccaacgacgaaccacctaactcccaacggacgacctaccgggacctaacgacgtacgggaacccgtagggaacggacgtccgtaggggaacgtacgttaccgtacggaaccgaccgtaccgggtccgttaggttacttacggtggtacggcggtaaggtaggttacggttaaacgggggttaaatttacggttttcggttaaaccgtttccgggtttaacccctttcggttttacggtaaccgtttaaccggggtccgggggacccggttaaccggggttaaccccgtttccgggg

SEQ ID NO: 391408 - DNA, 669 bp, Homo sapiens
  misc_feature: GZ8MTXP01AHAPQ.39.81.H04.1.454.CMB.2.raw
  modified_base (422)..(422): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaacttatggtatcgaggttgggtgcgacgacggcccctggacgaagggtcttggagtggagtgggatggatcgagcgtacttacgaagtcggtacacgaacaaactatcgacccaacacgtaaccctaccgaggggaacagcgtaccaaccctagacgacccaanacgaaccacactaccgaacgacgaccgaccggaccctaacacgtacggaccgtacggaaggacgccgtagggacgtactccgacggaccgacgaccggtcccgttagttacgttacgtggtaggacggaaggaacggttaagggttaacgggggttaaatttacggtttacgacggtttccggttacccgttgtttacgtaaccgttacgggtcggggacccgtaaccggggttaacccgttccggg

SEQ ID NO: 391409 - DNA, 719 bp, Homo sapiens
  misc_feature: GZ8MTXP01CKPNL.39.81.H04.1.454.CMB.2.raw
  modified_base (434)..(434): a, c, t, g, unknown or other
  modified_base (553)..(553): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctgttacaccttaccaactatggtatcaggttgggtgcgacacggcccctggacgaagggtcttggagtggagtgggatggatcgagcgtacttacgaattcggtacaacaactaaactagtacgacccaacgacgaaacccgtccgaggggaaccaaggcgtaccaaaccgatacgaacccaacacgaaccactacncccgaacggacgaccgaccggtacctaacgacgtacggacccgtaggacgggacgaccgttagggacgtacgttcgacggaacccgaccgtaccgggtaccgttagtaacgtttaccgnggtcggaacggaaggtaaggttaacgggttaaccgggggttaaattttaaggttttacggttaaccggtttccggtttaaccccgtttcgttttaccgggaacccgttaaccgggggttacgggggttaaccccgtaaaccgggggttaacccccgtttcccgggg

SEQ ID NO: 391410 - DNA, 692 bp, Homo sapiens
  misc_feature: GZ8MTXP01ACX9D.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtgttactacctttaccaactatggtatcgtaggttgggtgcgacacggcccctggacaagggtcttggagtggagtgggatggatcgagcgtacttaacgaaagttggtaccaaacaaactaaaactagtcgacccaacacggaaaccctccgaaggggaacaaggaacgtaccaacccgatccgaaccaacgaacgaacacactacccgaacggacacccgaacggtaccctaacgacgtcgggaacccgtaggaacgggacgtcccgttaggggaacgtacgttccgaacggaaaccggtacccgaaccggggtcccgttaaggttaacttaccgtaggtacggcggtaaggaacggttaggttaacggggaaatttacgtttgaccgtttcggttacccctttgttacgaacgtacgggtcggggaccgtaacgggttaacccgttcgg

SEQ ID NO: 391411 - DNA, 648 bp, Homo sapiens
  misc_feature: GZ8MTXP01D97VU.39.81.H04.1.454.CMB.2.raw
  modified_base (608)..(608): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctgttacacctttaccaatatggtatcagttgggtgcgacacggcccctggacaagggcttggagtggagtgggatggatcagcgtactttaacaattggtacaacaacaaaactatcgaccaaccgaagaaaccctcccgaaggggaccaaaggcgtaccaaccctaagtacgaacccaacgaacgaaccaacactacccaacggacgaccgaaccgggacccttaacgacgtacgggaacccgtagggaacgggaacgccccgtaggggaacgtactacgtacggaaccgaccgaccggtccgttagttacttacgtgtcgacggaagaggagtacggggttaaattagtttagacgttcgttacccttnttagaacgtacggcgggaccgtaacgggttaacccgtcgg

SEQ ID NO: 391412 - DNA, 699 bp, Homo sapiens
  misc_feature: GZ8MTXP01EU9VI.39.81.H04.1.454.CMB.2.raw
  modified_base (234)..(234): a, c, t, g, unknown or other
  modified_base (248)..(248): a, c, t, g, unknown or other
  modified_base (253)..(253): a, c, t, g, unknown or other
  modified_base (260)..(260): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctctgcagcttntgtacacttacatntgtancagtggncgacaggccctggacaaggctgagtggatgggatggatcgagcgtacttacaagttggtacaacaacaaactatcgacccaacaacgaacccgtcgaacggggacaaggcgtaccaaaccagttaaccgaacccaacgaacgaaccaacactacccgaacggacgacccgaccgggtaaccctaacgtaacgtcgggacccgtagggaagggaccgaccgttaggggaacgtacgtccgtacggaaccgaaccgtaccggggtcccgttagtaaccgtttacgtacggtcgggaacggaaggtaacggttaagggttaaccgggggttaaaatttttaggttttaacggttaccggtttaccggtttaccctttcggtttacggaaccggttaccgggtaccgggggacccgtaaccgggggttaacccctttccgggg

SEQ ID NO: 391413 - DNA, 617 bp, Homo sapiens
  misc_feature: GZ8MTXP01ARZMW.39.81.H04.1.454.CMB.2.raw
  modified_base (395)..(395): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactatgccacacgaaccctccgagggacagaagtcaaccatcgaaccacagacacanccacgagcacggacctacagtcggacctgaacggacgtccgtaggggacgtacttccgacggaaccgaccgaccgggtccgtagttacttacgtgtacggcggaaggaaggaaggtacgggggttaaaatttaggttttacgaccgttcgggttaccccttcgtttacgggaaccgttacgggtcgggggaccccgtaacgggggttaaccccgtttcgggg

SEQ ID NO: 391414 - DNA, 656 bp, Homo sapiens
  misc_feature: GZ8MTXP01D4CZ6.39.81.H04.1.454.CMB.2.raw
  modified_base (253)..(253): a, c, t, g, unknown or other
  modified_base (275)..(275): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgccccgtcacccttggacacgccggcctccatctcctgcaggtctagtcaaagcctcgtatacattgataggaaacncctattgaattggttcagcagnggcaggccaatcacaggcacttaaatttataggtttccaaccgggtctcgtggggtcccagacagtctcgaggcggcaggtcggggtcaacggtctaccgttagtaacttccaactacgtaagtaaaacgtcgaaggacggtaaggggtagggaacgggtacgtagggtaagggttagtttaggggtttagggggtttattacgttagggtacgtaagttacggtaacgaaacgggaaactaccgaacggttccggtacccgtttaccggttacgttaccggttttcgggacccggtaacgggggtaacaggaccgttaggaacgtaacgttaacgaaacggttaacgtggtacggctacggccttactaacttcgttccg

SEQ ID NO: 391415 - DNA, 592 bp, Homo sapiens
  misc_feature: GZ8MTXP01EEWOL.39.81.H04.1.454.CMB.2.raw
  modified_base (349)..(349): a, c, t, g, unknown or other
  modified_base (379)..(379): a, c, t, g, unknown or other
  modified_base (411)..(411): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacagacccctggacaagggcttgagtggatgggatggatcagcgactttacaattggtacactaacaaactntgacccaacagaaccctcgacgggaccagngtcaccatcgaaccacagacacactccacganccgacggacctacagtcggacctgacggagccctaggggacgacgttcaggaccgacgacggtccgtagttacttacgtggtcgcggaagaaggaggtcggggttaaatgttttacgaacgttcgggttaccccttgttacgaacgttacgtcgggggaccctaacggggaacccttcggg

SEQ ID NO: 391416 - DNA, 645 bp, Homo sapiens
  misc_feature: GZ8MTXP01D507C.39.81.H04.1.454.CMB.2.raw
  modified_base (329)..(329): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacaccttacaatatggtatcaggttggtgcgacacggcccctggacgaagggcttggaggtggagtgggatggatcagcgtacttanaagttcggtacaacaacaaactagtacgacccaacaacgaaccctcgaacggggaaccaagaacgtaccaacccgatacgaaccaacacgaacctacaactaccaacgacgaccgacggtaacctacgagtacggaccgtaggaacggacgtcccgtaggggaacgtacgtacgtaacggaaccggaccgaccgggtccgttaagttattacgtgtagcgaaggagttaggtaacggggttaaatttcgtttacgacgttcggttacccttgttacgtaacgtacggtcgggaccgtaaccgggttaaccgttcgg

SEQ ID NO: 391417 - DNA, 642 bp, Homo sapiens
  misc_feature: GZ8MTXP01CVLF9.39.81.H04.1.454.CMB.2.raw
  modified_base (317)..(317): a, c, t, g, unknown or other
  modified_base (327)..(327): a, c, t, g, unknown or other
  modified_base (329)..(329): a, c, t, g, unknown or other
  modified_base (353)..(353): a, c, t, g, unknown or other
  modified_base (613)..(613): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacacctacttgaatggttcagcagaggccaggccaatccacgagctacttaattagtacgttacgacgtcncggtcggcananagtactcgagcgacgtggtcgcgngactagtagtactcaactacgtaaagaaactgaacggacggggtaggggtagggacggtagttaaggggtaggttaggttttagggggttttaaggggtttaacttaggtacgtaggtaggttacggaaacggaaacggaaccgtaaccgtcggtacggttccccgttacgttaaccgtttaacggttccggaaccgggaaccgggtaacacggtcggttaagggaaactacgttaaacccgaaaacgttcgtaacgggngtcgtcgacccttactaacttcggttaac

SEQ ID NO: 391418 - DNA, 663 bp, Homo sapiens
  misc_feature: GZ8MTXP01B0YLS.39.81.H04.1.454.CMB.2.raw
  modified_base (347)..(347): a, c, t, g, unknown or other
  modified_base (359)..(359): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtacaaagcctgtatacattgatagaactacctactgtaattggtcagcagagccaggccaatctaccgaagcgtaccttaatttagtaacggtttactaaccgggctcgtcggggtacccagacagtnttccgaggcggngtaggtggtaacagggctacgtagtaacttccaactacgtaagaaaatcgagtacggaggggtggaggtcgtaagggaggttagtttgggtttaggggtttacttacgtagacgtaggtacggaacgtaaacggaaccgtaccgtaacgttccggtaccgtttacccggttacgtttaccggtttacgggaacccggtacgggggaaccctaaggttccgtaagggacgtaaacgtaaccgaaaacggttacggttggtcggtaccgtcggtaaccctaccttacgttccgttaacggtttccc

SEQ ID NO: 391419 - DNA, 643 bp, Homo sapiens
  misc_feature: GZ8MTXP01APM8J.39.81.H04.1.454.CMB.2.raw
  modified_base (350)..(350): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttgaggtggatgggatggatcgagcgcttaacaattggtacacacaaactntcgaccacagaaccctcgagggacagaacgtcaaccatacgaccacagtaaccacaactccaacgacgaccaccgggacctacagtcggacctggacgggacgcccgtagggagactcgtacggaccgaccgaccgggccgttagtattaccgtggtcggcggtaaggaggttaggtaacgggggttaaaatttacgtttttacggacgtttccggttaaccccgtttcgttttacggaaccgtttaaccgggtccgggggttaccctaaccgggggttaaccccgttcgggg

SEQ ID NO: 391420 - DNA, 698 bp, Homo sapiens
  misc_feature: GZ8MTXP01BANHI.39.81.H04.1.454.CMB.2.raw
  modified_base (343)..(343): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctacctttaccaactatggtatctaggttgggtgcgacacggcccctggacgaagggtcttaggaggtggagtgggatggatcgagcgtacttaanaagtcggtacaacaaacaaactatacgaccccaacgaacgtaacccgtccgaaggggaccaaggaacgtaccaaaccctaagtaccgaaacccaacacgaaccaacgtacacccgaacgacgaccgtaaccggacccttaacacgtacgggacctaggacggaacgtcccgtaagggacgtacgttaccgacggaaccgtaaccgccggtaccgttagttacgttacgtggacgacggaagtacggttaaggtaacggggttaaattacgtttacggaccgtttcggttaccctttgtttacggtaacgtttaccggggcggggacccggtaacggggttaacccgttaaccggg

SEQ ID NO: 391421 - DNA, 626 bp, Homo sapiens
  misc_feature: GZ8MTXP01BX7DN.39.81.H04.1.454.CMB.2.raw
  modified_base (240)..(240): a, c, t, g, unknown or other
  modified_base (355)..(355): a, c, t, g, unknown or other
  modified_base (401)..(401): a, c, t, g, unknown or other
  modified_base (409)..(409): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatggacgaagccgtggggcctcgagtgaagtctctgcaggcttntgttacaccttacactgtgtatcgtagtggtgcgacacggccctggacgaagggcttggagtgggagtgggatggatcgaggcgtcttaacaagttggaccaacaactaaacttncgaccacaagaaccctcgagggaacagcgtacaccgatacgaccanagacacanaccgacgacgcaccggactacagtcgggacctaggacgacgtccgtagggaacgtattcgacgggaacgccgtaacgggtccgttaggttactcgtggtgcggaaagtaggttaacggtacggggttaaatttcggtttagaccgtttcgggttaccctttggttaccgtaacggtaacgggtcgggggttacccgtaacgggttaaccccgttcgg

SEQ ID NO: 391422 - DNA, 577 bp, Homo sapiens
  misc_feature: GZ8MTXP01B1GH0.39.81.H04.1.454.CMB.2.raw
  modified_base (275)..(275): a, c, t, g, unknown or other
  modified_base (368)..(368): a, c, t, g, unknown or other
  modified_base (397)..(397): a, c, t, g, unknown or other
  modified_base (408)..(408): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatggggatggatcagcgcttacaatggtcacacaaactatgaccacagaacctccagggcagngtcaccatgaccacagacacatccacganacacggcctangtcggacctgaggagccctggagtatctaggaaccgaccgacgggcccgtaggtacttacgtcgtggcgaaggtagaggttacggggaaattagttttcggacgttcgggttaccccttgtttcgaacttacgggtcgggggaccctaacggggttaaccccgttcggg

SEQ ID NO: 391423 - DNA, 676 bp, Homo sapiens
  misc_feature: GZ8MTXP01AJ8HD.39.81.H04.1.454.CMB.2.raw
  modified_base (349)..(349): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacaggcccctggacgaagggcttgaggtggagtgggatggatcagcgtcttagaatggtacaacaacaaatntgacccacacgaaccctcgaggacagcgtcaccatcgaaccacagaccacgactaccgacgacgccgaaccggacctaacgagtacgggacccttagggaacggacgtcccgtaggggaacgtacgtccgtacggaaccggaaccggtaccgggtacccggttagttaacgtttaccgtaggtcggaccggaagggtaacggttaagggttaaaccgggggttaaatttacggtttttacggttaaccgttcggtttaccccgtttgtttacggtaaccgttaccggtacgggggacccgtaacgggggttaacccccgttaacggg

SEQ ID NO: 391424 - DNA, 670 bp, Homo sapiens
  misc_feature: GZ8MTXP01BOLRA.39.81.H04.1.454.CMB.2.raw
  modified_base (237)..(237): a, c, t, g, unknown or other
  modified_base (335)..(335): a, c, t, g, unknown or other
  modified_base (506)..(506): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttntgttacaccttacaactatggtatcgtaggttgggtgcgacgacggcccctggacgaagggcttggaggtggagtgggagtggatcgagcgtacttanaagtggtacaacaacgaaactatcgaccaacgaacgaaccctaccgagggaacaagaacgtaccaaccgatacgaaccaacgaacgaccaacgtacaccgaacgacgaccaccggtaccctaacagtacggaaccctagggaacggacgcccgtaagggacgtacgttacncgggaaacgaccggacggtaccgttagttacttacgtacggtcgacggtaaaggagttagggtaacgggttaaatttaggtttacggaacgtttccgttaccgtttaacgttcggtaaccttacggggtacgggacccgtaaacggggttaaccccgttccggg

SEQ ID NO: 391425 - DNA, 663 bp, Homo sapiens
  misc_feature: GZ8MTXP01BBR5B.39.81.H04.1.454.CMB.2.raw
  modified_base (350)..(350): a, c, t, g, unknown or other
  modified_base (376)..(376): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggagtgggatggatcgagcgtacttacaattggtcacaacaaactntacgccaacagacctccgaggacagngtcaccatcgaccacagacacactaccacgacgcaccggacctaacgagtacggaccctagggacggaacgcccgttagggaacggtactaccgtacggaaccgacccgtaaccgggtcccgttacgttacgttaacgtcggtacggccgtaaaggtacggttacggttacgggggttaaaactttaggttttcggaaaccgtttcggggttaacccctttggtttaccggtaaccgttacgggtacgggggttacccgtaaccgggggttaaccccgttaaccggg

SEQ ID NO: 391426 - DNA, 558 bp, Homo sapiens
  misc_feature: GZ8MTXP01CI0LV.39.81.H04.1.454.CMB.2.raw
  modified_base (347)..(347): a, c, t, g, unknown or other
  modified_base (382)..(382): a, c, t, g, unknown or other
  modified_base (389)..(389): a, c, t, g, unknown or other
  modified_base (471)..(471): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaagggcttgagtggatgggatggatcagcgcttacaattggtacacaacaaactntgaccacagaaccctccgagggacagcgtcaccancgaccanagacacactccacgacgcacggctacagtcgacctgaggagcctggacgatcgacgacgacgacggtccgtagtacttacgngtgcgtaagagagtacgggaaattagtttgacgttcggttacccttgttacgaactacggtcgggaccgtaacgggaacccgttcgg

SEQ ID NO: 391427 - DNA, 729 bp, Homo sapiens
  misc_feature: GZ8MTXP01EACDC.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccaggtggggatgttgtgatgactcagtctccagtcctccctgcccgtcacccttggacagcccgcctccactcctcctgcgtaggtctagtacaacgtcctacgtatactattagatacgaaactacctattagtaattggtacagcgagacggccacgaccatccacgaaggcctacttaatttaacgttaacggtttaccgtaaccggtacttcggtacgggtacccagactagtactccgacggcggacgtagggtcgggtaacgacgggtctacgtagtaacttccaactacgtaagaaaactcgaaggacggtagggggtaggaggtacgtagggagggttagtttggggtttagggtttacttacggtgtactacgggtacgaacggaaacgtaaccgtaaccgtaccggtccggttacccgttacccgttaacgtttaccggtttaccgggaacccggggtaacggggaaacccgtacggttacgggttaacgggaaacgtaacgtaaaaccggaaaaacggttcggttacgggtccgggtaacttccggaaccctaccgttactttaaccgtttcggtttaaccc

SEQ ID NO: 391428 - DNA, 710 bp, Homo sapiens
  misc_feature: GZ8MTXP01BVLHR.39.81.H04.1.454.CMB.2.raw
  modified_base (356)..(356): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctgttacacctttaccaactatggtatcaggttgggtgcgacaggcccctggacaagggcttggaggtggagtgggatggatcgagcgcttacaagttggtacacaactaaaacgtntcgacccaacacgaaacccgtccgaaggggacaagaacgtaccaacccgagtaccgaacccaacacgaaccacactaccccaacggacgaccgaaccggaccctacgacgtacggacctggaaggacgccgtagggaagtactcgtacggaaccgaccgaccgggtccgttacgttaacgttacgtcggtacggcggtaaaggaaggttaacggggttaacgggggttaaaatttaacggtttttacggaccgttttaccgggtttaccccgtttaagttttaccgggtaacccgtttaaccggggtaccgggggttaccccggtaaaccgggggttaaccccgtttcccgggg

SEQ ID NO: 391429 - DNA, 631 bp, Homo sapiens
  misc_feature: GZ8MTXP01EQTIJ.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgccccgtcacccttggacacgccgcctccatcctcctgcaggtctagtcaaagcctagtatacattgaataggaaacctaccttattgaattggttcagcagaggccaggccaatccaccgaaggccgtacctttaaattttaagtaacgggttttccaaacccgggtacttcgtacggggtacccaggacagacttcgaggcggcgaggtgggtcaagggcaactgaacttcaacactaagaaatcgaggcgagggtggaggcgtaggaggtagttggttagggtttattagtgacgtagttacggaacgaaacggaactacgaccgttcggtaccccgttacccgtacgttaccggtttcgggacccggtaaacgggggtaaccaaaggccggttaaggaacgtaacgttaacgaaacgttacgtggtacgcgtacgcacctaagttcgttcg

SEQ ID NO: 391430 - DNA, 530 bp, Homo sapiens
  misc_feature: GZ8MTXP01E4NNY.39.81.H04.1.454.CMB.2.raw
  modified_base (253)..(253): a, c, t, g, unknown or other
  modified_base (310)..(310): a, c, t, g, unknown or other
  modified_base (334)..(334): a, c, t, g, unknown or other
  modified_base (359)..(359): a, c, t, g, unknown or other
  modified_base (385)..(385): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatggaaacnctattgaattgttcagcagagcagccaatcacaaggcactaattatagttcaacggntcgtgggtccagacagatcagcgnaagtgggcaggcactgaacttcganactagaaatcagcgagggtggacggntaggaggtagtggttaggggtttattacgtggcatgacgaaaggacagacgtggctccgtactcgtttggaaccgaagggaccaagcgtaggaagacttacgaaacgtaacgtggtaacggctacggactaaccgttgttaaccg

SEQ ID NO: 391431 - DNA, 621 bp, Homo sapiens
  misc_feature: GZ8MTXP01EZJ0S.39.81.H04.1.454.CMB.2.raw
  modified_base (282)..(282): a, c, t, g, unknown or other
  modified_base (354)..(354): a, c, t, g, unknown or other
  modified_base (359)..(359): a, c, t, g, unknown or other
  modified_base (509)..(509): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtgaaggtctcctgcaaggtcttctggttacacctttaacaactatggtatcgtaggttgggtncgacacggcccctaggacaagggtcttggagtggagtgggatggatcgagcgtactacaagtcgtacacaanaactnacgcacagacctcgaagggcaagactcaaccatcgaaccatacgacacactaccgacgacgaccgtaaccggacctaacacgttacggacctaggacggacgccgtaggagtactacgacgaccgacgtacggtaccgtgtaagttacgngtcggaacggaaaggaggtaaacggttacggggtaaaatttcggttttacgcgtttacggtaacccttgtttaacgacgtacgttcggggtaacccgttaacgggtaacccg

SEQ ID NO: 391432 - DNA, 644 bp, Homo sapiens
  misc_feature: GZ8MTXP01BHYR1.39.81.H04.1.454.CMB.2.raw
  modified_base (253)..(253): a, c, t, g, unknown or other
  modified_base (286)..(286): a, c, t, g, unknown or other
  modified_base (343)..(343): a, c, t, g, unknown or other
  modified_base (444)..(444): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtccacccttggacagccggcctccatcctcctgcaggtctagtacaaagcctgtatacattgaatagaaacnctacttgaattggtcagcagagccagccaatcncaagcactaatttataagttctaacggctcgtcgggtccagacagattccgagcggngaggtggtacagggcacgtagtaacttacaactaagtaagaaaactcgagcggaggggtaggacgtcgtaggtaggttagttagggtttaggttattacgngtacgagggtagaacgtaaaggaactaaccgtacgtccggtacccttacccggttaacttaccgggttttacgggaaccggtacgggggaaaccgtaaacggttcgggtaaagggttaacgtaaacgtaaccgttaaaaccggttacgttacggggtcgacgttaacggaccgtaccttacgtttccgttaacgtttccc

SEQ ID NO: 391433 - DNA, 657 bp, Homo sapiens
  misc_feature: GZ8MTXP01EODCN.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcgagtgaaggtctctgcaggcttctgttacaccttacaactatggtatcgtaggttgggtgcgacgacggcccctggacgaagggtcttaggaggtggagtggggatggatcgagcgtacttacgaagtcggtacaacaacaaactatcgaccacgaacgaacctccgaggacagcgtcacacacgaccacagacacactaccagacgccaccggacctaagacgtacggacctagggaacggaacgcccgttagggggaacgtacgttaccgacggaaccgaaccggcgggtaccgttagttacttacggtcggtacgacggaaggtaagttacgggtaaacggggtttaatttacggttttacgacggtttccggttacccctttgtttacgtaacgttcggggtacggggaccgtaaccggggttaacccgtttccggg

SEQ ID NO: 391434 - DNA, 675 bp, Homo sapiens
  misc_feature: GZ8MTXP01ECCT5.39.81.H04.1.454.CMB.2.raw
  modified_base (347)..(347): a, c, t, g, unknown or other
  modified_base (377)..(377): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaactatggtatcagttgggtgcgacaggcccctggacaagggcttgagtggatgggatggatcgagcgctttacaattggtacacaacaaactntcgaccacacgaaccctcgaagggaccagngtcaccatcgaccacagacacactaccacgacgaccgacggaccctaacgtaacgtcggggaacccgttagggaacgggaacgtccccttagggggaacgtactaccgtacggaaccgaaccgacccggggtccgttaagggttactttaaccgtgggttacggcgggtaaggtaaggttaacgggttaacgggggttaaaatttaggttttacggttaacgtttcgggtttaaccccttcgttttacggaaccgttacgggtcgggggacccgtaaccggggttaacccgttccggg

SEQ ID NO: 391435 - DNA, 670 bp, Homo sapiens
  misc_feature: GZ8MTXP01CHORE.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtggaaggtctctgcaaggtcttctgttactacctttaccaactatggtatcgtagttgggtgcgacgacggcccctggacgaaggcttaggaggtggagtgggatggatcgaaggcgtacttacgaagtttcggtacaaacaacctaaaactatcgaccaccaacgaaccctccgagggaaccaagaacgtaccaaccatacgaccaacacgacaacacgtaccgaacggacgaccaaccgggaccctaacgacgtcgggtaacccgaggaacggacgaccgttaggacggtactcgtaacggaccgtaaccgaccgggtccgttaagtacttacgtggtggacggaaggtagaacgggtacgggttaaatttacgtttcgacgtttccgttaacccgttgtttacggaaccttacggggtcggggaccgtaaccggggttaaccgtttccgg

SEQ ID NO: 391436 - DNA, 682 bp, Homo sapiens
  misc_feature: GZ8MTXP01DY2U5.39.81.H04.1.454.CMB.2.raw
  modified_base (359)..(359): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcagtgaaggtctctgcagtcttctgttacacctttacactatggtatcaggttgggtgcggacacggcccctaggacgaagggcttggaggtggagtgggatggatcgagcgatttacaagttggtacaacaactaaaacgtntacgacccaacaacgaaccctccgacggggacaagaacgtacaaccctaagtcgaacccaacagaaacccaacaacacccgaacgacgacctacggacctaacagtacgggacctagggacggaacgccgtagggaacgtacgtaccgtacggaaccggaaccgcggtaccgttagttacttacgtggtacgcgggtaagaggttaacggtacggggttaaaatttacggtttcgttaaccgtttcgggtttacccttcgtttaaggtaacccgttaacgggtccgggggttacccgtaacgggggttaaccccgttccgggg

SEQ ID NO: 391437 - DNA, 696 bp, Homo sapiens
  misc_feature: GZ8MTXP01COOQM.39.81.H04.1.454.CMB.2.raw
  modified_base (278)..(278): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggtcttctgttactacctttaccaatatggtatcgaggttgggngcgacacggcccctaggacaagggcttggagtggagtgggatggatcgagcgtactttaacaaagttcggtacaaccaaacgtaaaaaccttagtacgaaccccaaacgaaacgtaaaccccgtccggaaaggggaacccaaaggaacgttacccaaacctaaacaccggaaacccaacgaacgaaacccaactacacccgaacgacgacccaacccggactaacgacgtacggaccaggacggaacgccgtaggaacgtataccgacggaaccgacgtaccggtccgttagttacttaacgtggtacgacggaagtaaggttaacggtaggggttaaatttagtttgaccgtttcggttaccctttcgttacgtaaccgttacgggtcggggacctaacggggttaaccccgtcggg

SEQ ID NO: 391438 - DNA, 644 bp, Homo sapiens
  misc_feature: GZ8MTXP01DTCWD.39.81.H04.1.454.CMB.2.raw
  modified_base (254)..(254): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggatgttgtgatgactcagtctccagtcctccctgcccgtcacccttggacagccgcctccatctcctgcaggtctagtacaaagtcctagtatacattgataggaaacnctactgtaatggttcagcagacggccaggccaatctacgaagcgtacttaaatttagtaacggtttacgaaacccgggtcttcggtacggggtaccccagacagtacttcgaggcggctagggtcgggtacaagggcctaacgtagaacttaccaacgtaactaagaaaactcgaagcggaggggtaggaggtacgtagggaggtaggttgggtttaggggtttacttagtaggactaagtggaacgtaaaggaaccacgtacgtcggtaccctacgttaccttacgtttaccggacggtaacgggtaaccaggtcgaagggtaacgtaacttaaccgttaaaacgacgttggtaacggtcgtacgaccttacctaacttccgttaaccg

SEQ ID NO: 391439 - DNA, 673 bp, Homo sapiens
  misc_feature: GZ8MTXP01CSNSH.39.81.H04.1.454.CMB.2.raw
  modified_base (357)..(357): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatcgaggttgggtgcgacacggcccctggacaagggcttggagtggatgggatggatcgaggcgacttaacaaagtggtacaacaacaaaactntgacccaacgaacgaccctacgagggaacaagaacgtacaacccagtccgaaccacaacgaaccacactaccaacgagaccgaccggacctaacagtcggacctggaacggacgaccgtaggggaagtacgttaccgacggaaccgaccgaccgggtccgttaagttattaaccgtggtacggaccggaaggtaagggttaagggttaccgggggttaaaatttaggttttcgaacccggtttcgggttaaccccttttgtttacgtaaccggttacggtcgggggttaccctaacgggggttaaccccgttcggg

SEQ ID NO: 391440 - DNA, 673 bp, Homo sapiens
  misc_feature: GZ8MTXP01EIXKL.39.81.H04.1.454.CMB.2.raw
  modified_base (236)..(236): a, c, t, g, unknown or other
  modified_base (255)..(255): a, c, t, g, unknown or other
  modified_base (348)..(348): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaggcttntgttacacctttacaactntggtatcagttggtgcgacaggcccctggacaagggcttgagtggatgggatggatcagcgctttaacaagttcggtacaacgaacaaaactntacgaccaaccgacgaaccctccgaggggaccaagcgtacacccgatacgaaccaacgacgaaccacactaccaacgacgaccgacccggtacctaacagtcggaaccgtgaacgggacgacccgttaggggaaacgtacgtaccgtaacgggaccgtaaccggaaccgggttccgttaacggtttacgttaaccgtggtacggacggaagtaacgggttaaggtacggggttaaaatttacgttttcgaacgtttcgggttaccccttgtttacgaacccggttacggtccgggggacccgtaacggggttaaccccgttcggg

SEQ ID NO: 391441 - DNA, 660 bp, Homo sapiens
  misc_feature: GZ8MTXP01BN453.39.81.H04.1.454.CMB.2.raw
  modified_base (273)..(273): a, c, t, g, unknown or other
  modified_base (344)..(344): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggngcgacaggcccctggacaagggcttgagtggatgggatggatcagcgacttacaatggtacacacaaactngccacagacctcagggcagcgtcaaccatcgaaccacagacacactccacgacgccgacggcctaacatacgggaccctggaacgggacgaccctagggggaacgtagtaccgtaggaacccgaacgacccggggtaccgttacggttaacgtttacccggtggttacgggacggaagggtaagggttaacggttacggggggttaaaactttggttttaacggttacgttcgggtttaccccctttggttttaccggaaccgttttaaccgggcggggggttaccccgtaacgggggttaaccccgtttcggggg

SEQ ID NO: 391442 - DNA, 616 bp, Homo sapiens
  misc_feature: GZ8MTXP01BDCG2.39.81.H04.1.454.CMB.2.raw
  modified_base (348)..(348): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacactttacaactatggtatcagttgggtgcgacaggcccctggacaagggcttggagtggatgggatggatcgagcgtactttacgaattggtacacaacaaactntgaccacagaaccctcgaggacagcgtcaccatcgaaccacagacacactacccacggacgaccaccggaccctacacgtacgggaccctggaacggacgccgtaggggagtacgttcgacggaaccgaccgaccgggccgttaggtaacttaccgtgtcgacgaaggaaggagtacggggttaaatttcgtttagaccgtttcgggttaccccttgttttacgaaccgtacggttcgggggaccctaacggggttaacccgttcggg

SEQ ID NO: 391443 - DNA, 693 bp, Homo sapiens
  misc_feature: GZ8MTXP01CE79P.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcgagtgaaggtctctgcagcttcgtgttacaccttacaactatgtatcgtaggttgggtgcgacgacggtccccgtaggaacgaagggtcttaggaggtggagtgggatggatcgagcgtacttaacgaagtggtacaacaacgtaaactagtcgacccacgaacgaacccgtaccgagggaacaaggaacgtaccaaaccgagtacgaacccaacgaacgaaccacacgtacccaacggacgaccgtaccggacctaacgagtacggaccgtaggaacggacgtcctaggggaacgtacgttcgaccggaacgaccgaccggtaccggttagtaagttcgtggtacggcggtaaaggtaggttaacggttaagggttaaagtttacggttttcgaccggtttcggtttacccttaacgtttacgtaaccgtttacgggccggggttaccgtaaccgggttaacccggtttaaccggg

SEQ ID NO: 391444 - DNA, 711 bp, Homo sapiens
  misc_feature: GZ8MTXP01BYWXZ.39.81.H04.1.454.CMB.2.raw
  modified_base (616)..(616): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttaccaactatggtatcaggttgggtgcgacgacggcccctggacgaagggtcttaggaggtggagtgggatggatcgagcgtactttaacaagttcggtaccaaacgaactaaaacgttatacgacccaaccgaacggtaaaccccgtacccggaagggggaaccaaacgggtaacgttacccaaacccgtaacgtaccggaaacccccaacgaaacggaaacccaaacctaacgtaccccgaaacgggacgacccgaaccgggtaccccttaacgacgttaccgggaaccctagggaacggacgtcccgtagggacgtaacgttcgacggaaccgacgccgggtccgttagtacttacggtgngcgaaggtcgaggttaacggggttaatttagtttcgacgttcgttaccccttaagttccggaactacgggcgggaccgtaacgggaacccttcgg

SEQ ID NO: 391445 - DNA, 710 bp, Homo sapiens
  misc_feature: GZ8MTXP01C1LQF.39.81.H04.1.454.CMB.2.raw
  modified_base (215)..(215): a, c, t, g, unknown or other
  modified_base (525)..(525): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctccgtgacaaggtcttcgtgttacctaccctttaaccaacttagttggtatcgtaggttgggtgcgacgacggccccgtaggacgaagggtcttaggagtggagtgggagtggactcgaagtccgtactttaacgaaagttcggaccaaaccaaactaaaaccgttgtaccgaaccccgaaccgaaacggtaacccctaccggaaggggaaccctaagggaacgttacccaaaccgaaataccgaaacccaacgaacgaaccctaacaccacccgaacggacgtaccgacggaaccctanaacgtcgacctaggacgacgcgtaggacgtagtcgacgacgtaccggacgtcgttagttataccgtgtacggagtaaggacgttagggtaacgggttaaattttcggttacgttacggtttcggttaccctttgttagaaccgtttacgggaccggggttaccgtaaccgggttccgttaaccgg

SEQ ID NO: 391446 - DNA, 744 bp, Homo sapiens
  misc_feature: GZ8MTXP01BUIFJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggtcttcgtggttactacctttaaccaactatggtatcgtaggttgggtgcgacgacggccccgtaggaaccgaagggtcttaggaggtggagtgggatggactcgagcgtacttacgaagttcggtaccaacaacgtaaaactgtacgaccaacgacgaacccgtccgaaggggaacaaggtcgtaccaacccagtaccgaaccaacgaagaccaacactaccgaacgacgacccgaaccgggtaccctaaacgacggtaccgggaaccgtacgggaacggaccgtcccgttaagggggaacgttaacggtaccgtaacgggaaccgtacccggtaaccgggtacccggtttaaggttacgtttaacccgtggttacggacgggtaaagggtaacggttaagggttaaaccgggggttaaatttacggtttacgttaccgttccgggttacccttcggtttacgaacgttacgggcggggttaacccggtaacgggttaacccgtccgg

SEQ ID NO: 391447 - DNA, 573 bp, Homo sapiens
  misc_feature: GZ8MTXP01B0O39.39.81.H04.1.454.CMB.2.raw
  modified_base (366)..(366): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaatggttcagcagagccaggccaatctccaaggcgtaccttaatttataaggtttctaacccgggacttcgtcgggggtacccagacagacttcagcggcaggtgggtcngggcactgaattcacactagaaatcagcgagggtggaggcgtaggaggtagttgggtttggggtttattacgtgacgtagtgtacgaaggaacacgacgtggacccttccgtactacgttttcgggccgaacggggtaaccaaggtcgttagggacgtagttaacgaaacgttaacgtggtggtctcggacttacctaagttcttcg

SEQ ID NO: 391448 - DNA, 578 bp, Homo sapiens
  misc_feature: GZ8MTXP01EMMP8.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccgcctccatctcctgcagtctagtcaaagcctcgtatacattgataggaaacactacttgaattggttcagcagaggccaggccaaatctaccaaggcctaccttaatttagtaacggtttcctaaccgggtactcgtaggggtcccagaccagattcgagcggcaagtcgggtcagggcactgtaattcgactaactagaaatcagcgagggtgaggcgtagaggtagttggttagggtttatacgtggctagtgtacaaaggacacgacgtacggtcctaccgtactacgtttacggcgtaacggggaccaacggttcgtacgggaagacgttaacgaaacgtaacgtgtaacggctggacctaacttaacgttcg

SEQ ID NO: 391449 - DNA, 663 bp, Homo sapiens
  misc_feature: GZ8MTXP01B9LY8.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttactaccttaccaacttatggtatcgtaggttgggtgcgacgacggcccctggacgaagggtcttggaggtggagtgggatggatcgagcgtacttaacgaagttggtacaaacaaacaaactatcgacccaacaacgaacccgtccgagggaacaaggcgtacaaccgatacgaaccaacacgaaaccacaactaccaacgacgaccgaaccggaccctaacgaacgtacggaacccgtgggaacggtacgaccgtaggggaagtacgttaccgaacggaaccgtaccgaaccgggtccgttagtaagttacgtggtacgacggaaggaaggttaggtaacggggttaaatttagtttcgaacgttcgttacccgttgttagtaacgtcgggtcgggaccgtaaccggttaacccgtcgg

SEQ ID NO: 391450 - DNA, 553 bp, Homo sapiens
  misc_feature: GZ8MTXP01EW2C9.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgataggaaacactattgaattggtcagcagagcaggccaatctacagcacttaatttataaggtttcaacgggactcgtgggtcccagacagatccgagcggcaggtgggaacagggcactagaacttcaactactagaaaatcgagcgagggtggaggcgtaggagtagtggtttagggtttatacgtgcagtgaacgaaggaacacacgtcgcccgttaccgtacttacgtttacgggaccgtagggggaaccaaggcgtaggaagtacgtaacgaaacgcgttggtcgctcgaccacactcgttcgttcc

SEQ ID NO: 391451 - DNA, 560 bp, Homo sapiens
  misc_feature: GZ8MTXP01AFCZ7.39.81.H04.1.454.CMB.2.raw
  modified_base (277)..(277): a, c, t, g, unknown or other
  modified_base (280)..(280): a, c, t, g, unknown or other
  modified_base (290)..(290): a, c, t, g, unknown or other
  modified_base (354)..(354): a, c, t, g, unknown or other
  modified_base (383)..(383): a, c, t, g, unknown or other
  modified_base (406)..(406): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctgcccgtcacccttggacagcccgcctccatctcctgcaggtctagtacaaagtcctacgtatacattgataggaaactactattgaattggttcagnagngccaggcaanctcaagctactaatttataaggtttcaaccggtctcgtgggtacccagacagtattcgagtcgngaagttggcaggcagtgtactcacactanaaatcaggcgagggtaggacggntaggtaggtagttgggtttacgggtttattacgtggacgtagagaacgaaacgacacgtacgtcgccgttccgtacgttccgtttggccggtacgggaccagttcgaggtaagacgttacgaaacgtaagtggtcgctacgctaaccgttgtcg

SEQ ID NO: 391452 - DNA, 634 bp, Homo sapiens
  misc_feature: GZ8MTXP01CUV05.39.81.H04.1.454.CMB.2.raw
  modified_base (267)..(267): a, c, t, g, unknown or other
  modified_base (347)..(347): a, c, t, g, unknown or other
  modified_base (386)..(386): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttacaccttacatatggtatcagttggngcgacacggccctggacgagggtcttgagtggagtgggatggatcgagcgcttaacgaagttcggtacacaactaaactntcgaccacacgaccctccgagggaacagcgtccaaccanacgaccacacgaccactacaccacgagaccgacggtacctacgacgtacggaaccgtaggaacggacgtaccgtagggacgtacgtcgacggaaccggacgaccgggtccgtagtacttacgtcgtgacggtaaggtaaggttaggttaacggggttaaattttacgtttcggttaaccgtttcggttaccctttgttacggtaaccgttacgggtccggggaccgtaaccgggttaacccgttcggg

SEQ ID NO: 391453 - DNA, 739 bp, Homo sapiens
  misc_feature: GZ8MTXP01DDNYJ.39.81.H04.1.454.CMB.2.raw
  modified_base (368)..(368): a, c, t, g, unknown or other
  modified_base (409)..(409): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggcttctgttacacctttaaccaacttatggtatcgtaggttgggtgcgacgacggccccctaggaccaagggtcttggaggtggagtgggatggatcagcgtacttacgaagttcggacaacaacaaaactntcgaccacaacgacctccgagggacaagaagtccaacctanacgaacccacgacgacaccactacccgacggacgaccaaccggacctaacgacgtacggaacccgttaggagggaacgtcccgtaggggaacgtacgttaccgaccgggaaccggaccgtaacccgggtaccggtttacgttaacgtttaccgtgggtacggaccgggtaaagggaaccggttaaagggtttaaaccgggggttaaatttttacggttttaacgggttaaacccgttttccgggttaaacccccttttggtttaaacggtaaccgtttaaacggggccgggggttaaaccccgtaacgggggttaacccccgtttcgggg

SEQ ID NO: 391454 - DNA, 644 bp, Homo sapiens
  misc_feature: GZ8MTXP01CPW62.39.81.H04.1.454.CMB.2.raw
  modified_base (354)..(354): a, c, t, g, unknown or other
  modified_base (397)..(397): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcagtgaaggtctctgcaggcttctgttacacctttacaactatggtatctaggttgggtgcgacacggcccctaggacaagggcttggagtggagtgggatggatcagcgtacttaacaagtggtacacaacaaactntcgacctacagacctcgaggacagcgtcaacatcgaacacganacactacaccaagacgaccaccggacttaacgagtcggaccagggacggaacgtcccgtaggggaacgtacgttaccgacggaaccgaaccgtaccgggtaccttaagggttacttaaccgtggtacggaccggtaaggtaagggttacggttaaacgggttaaatttacgtttcgaccgtttcgttacccgtttaagttagaaccgttaacgggtcggggaaccgtaacgggttaacccgttccgg

SEQ ID NO: 391455 - DNA, 666 bp, Homo sapiens
  misc_feature: GZ8MTXP01D4BHT.39.81.H04.1.454.CMB.2.raw
  modified_base (474)..(474): a, c, t, g, unknown or other
  modified_base (496)..(496): a, c, t, g, unknown or other
  modified_base (505)..(505): a, c, t, g, unknown or other
  modified_base (557)..(557): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactaccctttaccaactatggtatcgtaggttgggtgcgacgacggcccctaggacgaagggtcttggaggtggagtgggatggatccgagcgtacttaacagttaggtacaaacaactaaactacgtacggacccaaccgaacgtaaccctccgaagggacaagaacgtccaaaccgataccgaaccaacgagaccaactacacccgacgacgaccaacggaccctanagtcggacacggaggacaccgngggtaacgngttaccgaacggaaccgtaccgacgggtaccgttagttaacgttacgttggngtacgggaagacggttaaggtacgggttaaatttgtttacgacgttcgttaccccttgtttcgaaccgtttccgggacggggaccctaacggggttaaccccgttcggg

SEQ ID NO: 391456 - DNA, 657 bp, Homo sapiens
  misc_feature: GZ8MTXP01BKL1S.39.81.H04.1.454.CMB.2.raw
  modified_base (379)..(379): a, c, t, g, unknown or other
  modified_base (432)..(432): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgacgaaggtcttctagttactaccttacaatatggtatcgtaggttggtgcgacgacggcccgtaggacgaagggtcttaggaggtgggagtggggatggactcgacggtcgtacttaacgaagttcggtacaaaccaactaaactanacgacccaacgtaaccgaacccgtacggaggaaccaagtcgtacaaaccgtanacgaaccaacacgaaccctaacacacccgaacggacgaccgtaccggacctaacgagtacggaacgtaggaggacgtccgaggacgtacgtccgacggaaccgacgaccggttcggtatacgttacgtgacggtgaaggtacgttagggttaacgggttaatttagtttcgacgttccgttaccttgttacgaaccgtacggcgggaccgtaacggttcccgtcg

SEQ ID NO: 391457 - DNA, 645 bp, Homo sapiens
  misc_feature: GZ8MTXP01B6YIP.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaaatcctaccgaaaggcgtaccttaaattttaagtaaacgggttttcctaaacccggggacttccgtcgggggtccccagacagacttcgaggcggcaggtgggtccaagggcaacgtgaaacttcgacactagaaaatcagacgaggggtaggaggcgtagaggtagttggttagggtttattacgtgtcgagttggacgaaaggtaacaacgtacgtacggtacccgtaccgttaaccgtaccgttttcgggaccgtaacgggggaacccttaaggccgttagggaaacggtaacttaaaccgaaacggaaaccgttggttacggtaaccgttcggaccttacccgtaagtttccgtttcgg

SEQ ID NO: 391458 - DNA, 698 bp, Homo sapiens
  misc_feature: GZ8MTXP01D6J4Q.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcgtgggcctcagtgaagtctctgcagtcttctgtactaccttacactatggtatcgtaggttgggtgcgacgacggccccgtaggacgaagggtcttggaggtggagtggggatggatcgagcgtacttaacagttcggtacaacaacaaaactatcgacccaacaacgaacccctcgacgggacaagaacgtaccaaccatacgaacccaacgacgaaccaactacacccgaacggacgcccgaacccgggtaccctaacgacgtaccgggaacccgtagggaacgggtaacgcccgttaggggaaacgtacgttaccgacggaaccgaccggaccgggttaccgttaacgttacgttaaccgtggtcggacggaaaggtacggaacgggttaacgggggttaaaatttggttttacggaaccgtttcgggttaaccctttgtttacggaacgtttacgggcggggttaccgtaaccgggttaacccgttccgg

SEQ ID NO: 391459 - DNA, 608 bp, Homo sapiens
  misc_feature: GZ8MTXP01ADZJN.39.81.H04.1.454.CMB.2.raw
  modified_base (289)..(289): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaattggtcagcagagccaggccaatctcaagcnctaatttataaggtttctaaccgggctcgtggggtcccagacagattccaggcggcaggtgggtacagggcaacgtgaaacttcaacgtactagaaaactcaaggcgaggggtggaaggtcgtaggaggtagttgggtttaggggtttatacgtgacgtagtagacgtaaacggaacacgacgtcggtaccctaccggttactacggtttacgggacccgtaagggggaacccaaggttccgtagggaacgtaagtaacccgaaacggaacgttcggtaacgggtactcggtaccaccgttacttccgttcgtttcccg

SEQ ID NO: 391460 - DNA, 621 bp, Homo sapiens
  misc_feature: GZ8MTXP01BODZ5.39.81.H04.1.454.CMB.2.raw
  modified_base (347)..(347): a, c, t, g, unknown or other
  modified_base (376)..(376): a, c, t, g, unknown or other
  modified_base (522)..(522): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgtacttacaatggtacacaacaaactntcgacccacacgaaccctcgagggacagngtcaccatcgaaccacagtaccacaactccaacgacgaccaccggacccttacgacgtcggaaccctggaacgggaacgcccgtagggaacgtaacgttccgacggaacccggaacgaccgggtaccgttagtacttaccgttggnggacgaaggaacgttaggtacggggttaaattagtttcgacgttcggttaccttgttacgaacttacggtcgggaccgtaaccgggttaacccgttcgg

SEQ ID NO: 391461 - DNA, 711 bp, Homo sapiens
  misc_feature: GZ8MTXP01DRV7J.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttaccaactatggtatcaggttggtgcgacacggcccctggacagggtcttggagtggagtgggatggatcagcgtcttacaagtggtacaacaacaaactatcgaccaacgacgtaaacccctccgaaaggggcaaggacgtacccaaaccataccgacccaacaacgaccactacacccgaacgacgacccaaccgggtacccttaacacggtacgggaaacccgttgggaaacgggtaccgacccggttaaggaacggtaaacttccgtaacgggaacccgaaccgtaccgggtaccggttagttaacgtttaaccgtggttacggaacggtaaggaaggtaacgggttaacgggggttaaaatttcggtttttacggaccgtttacgggtttaacccctttgtttaacggaccgttacgggttcgggggtaacccgttaacggggttaacccccg

SEQ ID NO: 391462 - DNA, 651 bp, Homo sapiens
  misc_feature: GZ8MTXP01D1SZ3.39.81.H04.1.454.CMB.2.raw
  modified_base (426)..(426): a, c, t, g, unknown or other
  modified_base (612)..(612): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctgttacacctttaccaactatggtatcgaggttgggtgcgacgacggccccgtggacgaagggtcttggagtggagtgggatggatcgagcgtactttaacaagttcggtacaacaactaaactatacgacccacaacgaaccctccggaagggaccagaacgtaccaaaccagtaccgaacccaanacgaacaaccactacccaacgacgcgaaccggacctacacgtcggaccgttaggacggaacgtcccgtaggggaacgtacgtccgtacggaaccggaccgacgggtaccgttagtacgttaccgtggtacgcggaaggaggttaggtacggggttaaattagtttcgttacgttccgttaccgttnttacgcgttacggtcgggaccgtaacgggttcccgtcgg

SEQ ID NO: 391463 - DNA, 614 bp, Homo sapiens
  misc_feature: GZ8MTXP01CEK3Y.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccgcctcatctcctgcaggtctagtacaaagcctcgtatacattgataggaaactactattgaattggttcagcagacgccagccaatctaccaaggctacttaatttacgtaacggtttccaaccgggctcgtacgggtacccagacagtacttcgaggtcggactaagggtgggtcagggctaacgtagaacttacaaactactaagtaaaactcgaagcggaaggggtggagggtacgtaggaggtagttggttaggggtttattacgtggactagtagacgaaaggaacacgacgtacggccttaccgtacgttaccgtttacgggccgtaacggggactaaaggcgtaggaacgttacgttaacgaaacgtaacgtggtaaggtcctacggacctaaccttaacgttccg

SEQ ID NO: 391464 - DNA, 624 bp, Homo sapiens
  misc_feature: GZ8MTXP01DJDRE.39.81.H04.1.454.CMB.2.raw
  modified_base (239)..(239): a, c, t, g, unknown or other
  modified_base (332)..(332): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttcnggaatccaccctcaccgacgtctatatgcactggtgcgacacggcccctggacaagggcttggagtggatggggatggatacgaacggtaacnggtggtctacgaactaaattatcgacaaacgaggtaaagtttcgaaggggtacgaacggggtaccaaccacgtacgacccgacggggacaccgtaccacgtacaaacacgtagacctaacagtacggaacgtagacgcgaggtcgtagggaatacgtactacgacggaccgacggtcgtagttatttagtgtcggagaagaagttgtacggattacgttcttacgttagttacggtggggtttacgggtaagtttaagtacgtttcgggttaacccgaacccggtaacgggg

SEQ ID NO: 391465 - DNA, 646 bp, Homo sapiens
  misc_feature: GZ8MTXP01AX4CO.39.81.H04.1.454.CMB.2.raw
  modified_base (373)..(373): a, c, t, g, unknown or other
  modified_base (426)..(426): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctgagtgaaggtctccgtgcaaggtcttcgtaggttaacctacctttaaccaacttagtaggtatcgtaggttgggtcgcgacgacggcccctaggaacgtaagggtctaggagtggagtggggatggatcgagctacttacgagtcgacaacaacaaatnacgacacgaacgacctcgaaacgggtcaagacgtacaaccagtaccgaaccanaacgaccaactaccgaccgacgacgaccgaaccggccctaagtacgaccgggtacagggacgcgtcgtaggacgtctacggacggacgcgacgggttccgtagttaaccgtgtgggacggaacgaaggttacgttaaggttacgggttaattttcgttacggttacttccgttaaccgttgtaacggacgttcgggacgggtccaacccgggttaacccg

SEQ ID NO: 391466 - DNA, 675 bp, Homo sapiens
  misc_feature: GZ8MTXP01AK78O.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtattagttgggtgcgacaggcccctggacaagggcttggagtggatgggatgggatcgagcgtcttaacgaagtggtacaacgaacaaaactatgacaaccacgaacctcgaaggggcaaagacgtccaccgatacgaaccacgagacacactacccaacggacgacctaaccggccctaacgacgttcgggaacccgtagggacggaacgccgttaggaacgggtaactccgtacggaaccggaaccgaccggggtccgttagttaacgttaccgtggtggaccggaaggaaggtaacggttaacgggggtaaaattttgttttacggaaccgtttcgggttaccctttacgtttggaaccgttaacgggtcgggggacccgttaacggggtaacccccgttggtaaccccg

SEQ ID NO: 391467 - DNA, 666 bp, Homo sapiens
  misc_feature: GZ8MTXP01DPB92.39.81.H04.1.454.CMB.2.raw
  modified_base (363)..(363): a, c, t, g, unknown or other
  modified_base (400)..(400): a, c, t, g, unknown or other
  modified_base (408)..(408): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaagtcttctgttactacctttacaactatggtatcgtaggttgggtgcgacgacggcccctagggacgaagggtcttggaggtggagtgggatggatcgagtcgtacttacagttggtacaacaactaaactntacgaccacaacgaccctcgagggacagcgtcaacanacgaccanacgacacactccacgacgccacggaccctagagtacgaccgtagacggacgtaccgtaggggaacgtacgttaccgacgggaacccggaacgtacccgggtaccggtttaagttacgttacgtggtacggtacgggaaaggtacggttaagggttaaacggggttaaattttacggttcggttaaccgtttccggttaacccgtttgttaacgaacgttcgggtaccggggaccgtaaccggggttaaccccgttcgg

SEQ ID NO: 391468 - DNA, 662 bp, Homo sapiens
  misc_feature: GZ8MTXP01DRJG6.39.81.H04.1.454.CMB.2.raw
  modified_base (213)..(213): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctgggcctnagtgaggtctctgcaggcttctggtactacctttacaactatggtatcgaggttggtgcgacacggcccctggaacagggtcttggagtggagtggggatggactcgagcgtactaacgaagtcggtacaacaactaaactatccgacacgaacgaaccctcgaaagggcaaggatccaacatacgacccaagacgacacactacgaacgacgaccgaaccggtaccttaagacgtacggaaccgtggaacgggtacgtcccggtaaggtacgaacgttcgacggaaccggtaccgtaccggggtaccgttagttaacgttacgtggacggaacggaaggttaggtacgggttaacgggggtaaatttcggtttcggacgtttaccgggttcccttacgttcggtacccggtacgggttacggggtaacccttaacgggggtaaccccg

SEQ ID NO: 391469 - DNA, 662 bp, Homo sapiens
  misc_feature: GZ8MTXP01CQULE.39.81.H04.1.454.CMB.2.raw
  modified_base (355)..(355): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctgttacacctttacaactatggtatcgagttgggtgcgacacggcccctggaccaagggcttggagtggagtgggatggatcgagcgtacttacaagtttcggccaacactaaaactntacgacccaacgagaaccctccgaaggggctaacgaagtccaaccagtacgaccaacacgaccactacacccaacgacgacgaccggacctacgacgtacggaccctggaacgacgcccgtaggggagtattccaggaccgaccgacgggcgttacgtagttccgtaggtcgacggaaggaaggttacggttaaacgggggaaattttaacggtttacgttacccggtttcggtttacccccgttgtttacggtaacccgtaacgggttcgggggcccgtaaaccgggggttaaccccgtttccggg

SEQ ID NO: 391470 - DNA, 677 bp, Homo sapiens
  misc_feature: GZ8MTXP01CD148.39.81.H04.1.454.CMB.2.raw
  modified_base (439)..(439): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccactcccaggttcagctggtacagtctggagctgagatgacgaagccgtggggcctgagtgaaggtctccgtgacaaggtcttcgtaggttaacctacctttaaccaacttagtggttaatcgtagggtttgggcgccggaacgaccgggtccccgtagggaaccgaaggggtcttaggaggtggtaggtgggatggatcgagtcgtactagaagtggaacacaacaaatgtacgacccacgacgaacccgtaggaggaaccaagtcaccaaccgtanacgaaccaagaactaaccacaaccgacgaacgacacccgtaccggtactaacgagtcggaaaccgtgggaacgaccgcgtagggaacgtagtccgaacggaccgacgtaccggtcgtttacgttatcgtggacgacgtaaggtaaggaggttaacgggttaatttacggtttacgccgttacggttaccctttggtaacgtaacggtacgggtccgggaccgtaacggttcccgttcg

SEQ ID NO: 391471 - DNA, 709 bp, Homo sapiens
  misc_feature: GZ8MTXP01C2HNS.39.81.H04.1.454.CMB.2.raw
  modified_base (382)..(382): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtagaaggtctccgtgcgaaggtcttcgtggttacctaccctttaaccaacttatggtatcgtaggttgggtgcgacgacggccccgtaggaacgtaagggtcttggaggtggagtgggatggatcgagcgtacttaacgagtcggtacaacgaaactaaactntacgaccaaccgaacgaaccctcggaaggaacaacgaacgtaccaaccgaagtaccgaaccaacaacgaaccaacacgtacccgaaggaacgaccgaccggtacctacgacgtacggtaccgagacggacgtccgtagggacgtacgttaccgaggaaccgacgtacggtccgttagtactcggtggacgtacggaagtaagggttacggttaaacgggaaattttacgtttcggttaacccgtttcggttaccccgttttaacgtacggtaaccggttaccggggtcgggggttacccgtaaccgggggttaaccccgtttccggg

SEQ ID NO: 391472 - DNA, 666 bp, Homo sapiens
  misc_feature: GZ8MTXP01BEQXV.39.81.H04.1.454.CMB.2.raw
  modified_base (276)..(276): a, c, t, g, unknown or other
  modified_base (347)..(347): a, c, t, g, unknown or other
  modified_base (397)..(397): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttcgtgttacacctttaccaactatggtatcagttgggtncgacaggcccctggacaagggcttgaggtggatgggatggatcagcgcttacgaatggtacacaacaaatntgacccacaacgaaccctccgagggacagaacgtccaaccatcgaaccanaacgaacacataccacggacgaccaccgggaccctaacgactcgggaacctacggaacgggacgcccgtagggaacgtacgtccgtacggaacgaccgaccgggcccggttagtaacttacggtcgtacgggcggtaaggaaggttaacgggttaacgggggttaaatttacggttttacggttaccgtttaccggttaacccgtttcgtttacggaaccgtttaacgggcgggggttaccgtaaccggggttaacccgtttaaccggg

SEQ ID NO: 391473 - DNA, 664 bp, Homo sapiens
  misc_feature: GZ8MTXP01BJI81.39.81.H04.1.454.CMB.2.raw
  modified_base (413)..(413): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccaggtggggatgttgtgatgactcagtctccagtcctccctgcccgtcacccttggacagccgcctccatctcctgcaggtctagtacaaagcctagtatacattgataggaaactacctattagaatttggtacagcagacgcagccaatctaccgaaggctacttaatttataaggttcgtaacggctcgtgggtccagacagattccgaggcggcaggtgggtaacagggcaactgaattcaactacgtagaaaatcgagacgagggtggaggngtaggaggtagttgggtttagggtttattacgtaggtactaaggtacggaacggtaaacgggaacctacgtaccgtcggtacccgttaccggttaaccttaccggttttacgggacccggtaacgggggtaaacctaacgggttaccggtaagggttaaacgaaacgtaaaccgttaaaaccgggttacgttacgggtaacggtaccgttaaccggaaccctaccgttacgtttccgtttaacggtttccc

SEQ ID NO: 391474 - DNA, 637 bp, Homo sapiens
  misc_feature: GZ8MTXP01C2X42.39.81.H04.1.454.CMB.2.raw
  modified_base (270)..(270): a, c, t, g, unknown or other
  modified_base (275)..(275): a, c, t, g, unknown or other
  modified_base (282)..(282): a, c, t, g, unknown or other
  modified_base (326)..(326): a, c, t, g, unknown or other
  modified_base (454)..(454): a, c, t, g, unknown or other
  modified_base (529)..(529): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacaccttacaatatggtatcagtggtncgacncggcccnggacaagggcttggagtggagtgggatggatcgagcgacttaanaagtggtacaacaacaaactatcgaccaacaacgtaacccgtccgaaggggaacaagaacgtacaacccaagtaccgaaccaacaacgaaccaaccactacccgaacgacaccgaccggacccttaanacgtcggaccgtagacggacgccgtaggaacgattacgacggaacgaaccgtacggaccgttagtactttacggngtacgaggaagtaggttaggtaacggttaagtttagtttacgaacgttccgttaaccttcgttacgtaacgtcgggtaccgggttaccgtaaccgggttaaccgtcgg

SEQ ID NO: 391475 - DNA, 682 bp, Homo sapiens
  misc_feature: GZ8MTXP01C04IQ.39.81.H04.1.454.CMB.2.raw
  modified_base (276)..(276): a, c, t, g, unknown or other
  modified_base (362)..(362): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagcgtgggcctgagtgaaggtctctgcaaggcttcgtgttactacctttacaacttatggtatcgtaggttgggngcgacgcggccccgtggacgagggtcttggaggtggagtgggagtggatcgagcgtacttacaagttcggaccaacaacaaacgtntacgacccacgaacgacccgtcgagggacagcgtaccaccatcgaaccacaacgaccactacacccgaacggacgaccgacccggacctaacgacgtcggaccgtagggacggtacgaccgtagggaacgtacgtcgacggaccgaccgacggtccgttagtacgtacgtggtcgacggtaaggtacggttaagggttaacggggttaaactttttacggttacggttaaccgtttccgggtttaacccctttgggttttaccggaacccggtttaccggggtcgggggaaccccgtaaccggggttaacccgttccggg

SEQ ID NO: 391476 - DNA, 627 bp, Homo sapiens
  misc_feature: GZ8MTXP01E0N9X.39.81.H04.1.454.CMB.2.raw
  modified_base (343)..(343): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctccgagggcagngtcaccatgaccacagacacatccacgagcacggccctacagtcgggaacctggaacggacgcccgtaggggacggtatccgtacggaaccggaccgaaccggggtcccgttaggttaacttaccgtggtcgcgggaaaggaaggttaacggtaccgggggttaaaatttacgttttacggacgtttcgggttaacccctttcgtttacgaaccgttaacggtcgggggacccgtaacgggggttaacccccgttcgggg

SEQ ID NO: 391477 - DNA, 700 bp, Homo sapiens
  misc_feature: GZ8MTXP01BQQAU.39.81.H04.1.454.CMB.2.raw
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcagtcttctgttactacctttacaactatggtatgtaggttggtgcgacgacggcccctaggacgaagggtcttggaggtggagtgggagtggatcgagcgtacttaagaagtcggtaccaaacaactaaactanacgaccaacaacgaaacccgtccggaagggaaccaaggcgtaccaaccgagtacgaacccaacgaacgaccacaactaccgaacgacgaccgaccgtacccgtaacgacgttcggaacccgtggaacggacgtacccgtaggggaacgtacgtccgacggaaccgaaccgtaccgggtccgttaagttacgttacgtcggtacggacggaaagggtaacggttagggtaacggggttaaatttacggtttacggttaccgtttccggttacccgtttaagtttcggtaaccgttacgggcgggttacccgtaaccgggttaaccggttaacccgg

SEQ ID NO: 391478 - DNA, 578 bp, Homo sapiens
  misc_feature: GZ8MTXP01BHXYX.39.81.H04.1.454.CMB.2.raw
  modified_base (276)..(276): a, c, t, g, unknown or other
  modified_base (278)..(278): a, c, t, g, unknown or other
  modified_base (291)..(291): a, c, t, g, unknown or other
  modified_base (302)..(302): a, c, t, g, unknown or other
  modified_base (318)..(318): a, c, t, g, unknown or other
  modified_base (330)..(330): a, c, t, g, unknown or other
  modified_base (392)..(392): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtccaggatccagtggggatgttgtgatgactcagtctccagtcctccctgccccgtcacccttggacagccgcctccatctcctgcaggtctagtacaaagcctagtatacattgatagaaactctatgtattgtcagcagagcagccancncagcactatttanagttcaacggntcgtgggtaccagacngactcgaggcgngaggtggacaggcaactagaacttcactacgaagtaaaactcaagtcgaggggtaggacggngtaggaagggtagttggggtttagggtttatacgtgtacgtagtacggaacgtaaaggaacacgtaacgtcggtcctaccgttacgtcgttacggaccgaaggggaaccaggttccgtagggataaacgtaacgttaaacggttacgttgtaacgggcttaacgactacgttacttcttcgtttcc

SEQ ID NO: 391479 - DNA, 642 bp, Homo sapiens
  misc_feature: GZ8MTXP01D7CH1.39.81.H04.1.454.CMB.2.raw
  modified_base (251)..(251): a, c, t, g, unknown or other
  modified_base (266)..(266): a, c, t, g, unknown or other
  modified_base (269)..(269): a, c, t, g, unknown or other
  modified_base (599)..(599): a, c, t, g, unknown or other
  modified_base (625)..(625): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctgccccgtcacccttggacagccgcctcatctcctgcaggtctagtcaaagcctgtatacattgatgaaacnctatgaattgtcagnagngccaggccaatctacaaggcctacttaatttacgtaaggtttccaaacggctgtacgggcccagactagacttcgaggtcggcgtaaagggtcgggtcagggcctaacgtagtaaacttcaaacgtaacttaacgaaaaagttccgaaggaccgggtaaagggggttacggggaaacggggtccgttaaggggtaacggggttagtttagggggttttacggggttttaaatttaccggtagggggtactaagttacggaaaccgaaaggtaaccaccgtacggttacggtcccttaccggtaatccgttcggaacgtacgggacaacgngtacgagacttacgaaacgtaatggnggtcacgcaaccttgtc

SEQ ID NO: 391480 - DNA, 612 bp, Homo sapiens
  misc_feature: GZ8MTXP01EMNP6.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttaccaactatggtatctagttggtgcgacacggcccctggacgaagggtcttgagtggagtgggatggatcgagcgacttacatggtacacaacaaactatcgacccaactaacgaccctccgaggacagcgtacacatacgaccacagacacatccacgacgccacggacctaacagtacggaccgtaggacggacgacccgtaggggaacgtacgtaccgtagaaccgacgacgggtccgtaggttactacgttggcgtacggaaggtagttacggtaggggttaaattagttttacgacgttcggttacccttgttacgaacgttacggtcgggaccgtaacgggttaacccgtcgg

SEQ ID NO: 391481 - DNA, 549 bp, Homo sapiens
  misc_feature: GZ8MTXP01E0XKT.39.81.H04.1.454.CMB.2.raw
  modified_base (343)..(343): a, c, t, g, unknown or other
  modified_base (511)..(511): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaatggcttgagtggatgggatggatcagcgcttacaatggtcacacaaactntcgcacagaccctccaagggcaagacgtcaccatcgaccacagacacactccacgacgcacggcctacatcggacctgacggacgccgtgagatcgtgacgacgacggccgtgtattacgtgtgcgagaggagttacggggtaaattagtttgcttcggtaacccctntttcgacgtacgttcggggtcccgaaggggtaaccccg

SEQ ID NO: 391482 - DNA, 615 bp, Homo sapiens
  misc_feature: GZ8MTXP01DSQAI.39.81.H04.1.454.CMB.2.raw
  modified_base (201)..(201): a, c, t, g, unknown or other
  modified_base (286)..(286): a, c, t, g, unknown or other
  modified_base (584)..(584): a, c, t, g, unknown or other
  modified_base (597)..(597): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccgaggtggggatgttgtgatgactcagtctccagtcctccctcgcccgtcacccgttggacncgccgcctcatctctgctaggtctagtacaaacgtcctagtatacattagagtacggaaactaccttattagtaattggttcagnaggacggccagaccaactctaccgaacggctaaccttaaagtttacgttaacggtttaccgaaccgggtctccggtcgggtaccagacgtagtatacgagcggacgtaagggtgggtcgaggtacctaacgtagtaaactcgaaacaaacgtaagaaaacgttcgaagggacgtagggggtagggacggtgtagggtaggtagttcgggtttaggtttatacgtggacgtagtacgacgtaaagaacacgtacgtcgaccttccgtacttcggtcgaacgtaggactagcgtaggaanacttagaaactgngtcgctcgactcttgtcg

SEQ ID NO: 391483 - DNA, 575 bp, Homo sapiens
  misc_feature: GZ8MTXP01BF8WV.39.81.H04.1.454.CMB.2.raw
  modified_base (252)..(252): a, c, t, g, unknown or other
  modified_base (330)..(330): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctacttgaattggttcagcagaggccaggccaaatcctaccaagggctacctaatttactaaggtttcaaaccgggntcgtggggtcccagacagactcgagcggcaagggtgggtccagggccacgtgaacttcgaactactagaaaatcgagacgagggtggaggctggaggtagttgggtttaggggtttattacgtggggctagtcgacgaaacggacacgacgtcgggcctccggtactacgtttcgggaaccgacggggaccaagcgtaggaacgattacgaaacgtaacgtgtaacgctgacctaacgaattccg

SEQ ID NO: 391484 - DNA, 586 bp, Homo sapiens
  misc_feature: GZ8MTXP01B3JWT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgtcttacaagtggtacacaacaaactatcgaccacagaaccctccgagggaccaagcgtcaaccatacgaaccacacgacacactaccacgagacacggacctacagtcggacctggaaggacgccgtggagatcgtagacgacgacggcgttagtatacgtgtcgcgaagagaggtacggggttaaattagtttggacgttcggttacccctttgttacgaaccgttcggtacgggggcccgtaacggggttaacccgttccggg

SEQ ID NO: 391485 - DNA, 604 bp, Homo sapiens
  misc_feature: GZ8MTXP01D10Z6.39.81.H04.1.454.CMB.2.raw
  modified_base (349)..(349): a, c, t, g, unknown or other
  modified_base (416)..(416): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgacttaacaatggtacaacaacaaactntcgaccactagaaccctcgagggacaagcgtaccaacatacgaaccacagaccacactaccaacganaccgacggacctagagtcggacctggacggacgccgtaggggaacgtacgttacgacggaaccgacgacgggtccgttagtacttacgtgtcgacggtaagagttaggtacgggttaaatttgtttacgacgttcggttacccttgttacgaaccgttcggtcgggaccgtaacgggaacccgttcgg

SEQ ID NO: 391486 - DNA, 678 bp, Homo sapiens
  misc_feature: GZ8MTXP01EPC9C.39.81.H04.1.454.CMB.2.raw
  modified_base (234)..(234): a, c, t, g, unknown or other
  modified_base (250)..(250): a, c, t, g, unknown or other
  modified_base (266)..(266): a, c, t, g, unknown or other
  modified_base (355)..(355): a, c, t, g, unknown or other
  modified_base (417)..(417): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgagtctctgcagtcttntgtactacttacactntggtatcgaggttggngcgacgacggccccgtaggaacgaagggtcttggaggtggagtgggagtggatcgagcgtacttaacgagtggtacaacgaacaaactnacgaccacgaacgtaaccctcgaggaacaagcgtacaaccataccgaaccacgagaacctanactaccgaacgacgtaccgaaccggtaccctaacgacgtaccgggaaccttgggaaacggaccgtaccgaggggacgtaacgttccgaacggaaccgaccgaccggtccgttaagttcttaacgtggacgacggaaggtaacgttagggtaacggggttaaatttcggtttaacgttacgttccgggttaaccctttcggttaacggtaaccggttaccgggttaccgggacccgggttaaccgggaacccgtttccgggg

SEQ ID NO: 391487 - DNA, 713 bp, Homo sapiens
  misc_feature: GZ8MTXP01AXHVV.39.81.H04.1.454.CMB.2.raw
  modified_base (497)..(497): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgacaaggtcttcgtggttaacctaccctttaaccaacttatgggttaatcgtaaggttggggtgccgacgacggcccccgtggaaccgaaagggtcttaggaggtggagtgggatggatcgagcgtacttaacgaagttcggtacaaacgaacctaaaacttagacgacccaaccgaaacggaaacccgtccggaacgggggaacaaacggtaacggtacccaaaccctaacgtaccgaaacccaacgaaacgtaacccaactaacncccgaaacgacgaccgaaccggacctaacgaacgtcggacctaggaacggacgtccgtagggacgacttcgacgaaccggacgaccggtccgttagtacttcgtagtcgacggaagtacgagggtaacgggttaaatttagtttcgaccgttcggttaccccttggttacgaacgttaccgggcggggaacccgtaacggggttcccgttaacggg

SEQ ID NO: 391488 - DNA, 675 bp, Homo sapiens
  misc_feature: GZ8MTXP01BX9OB.39.81.H04.1.454.CMB.2.raw
  modified_base (190)..(190): a, c, t, g, unknown or other
  modified_base (336)..(336): a, c, t, g, unknown or other
  modified_base (358)..(358): a, c, t, g, unknown or other
  modified_base (409)..(409): a, c, t, g, unknown or other
  modified_base (485)..(485): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatgacgaagccgtgggcctcagtgaaggtctctgcaaggtcttctgttactacctttacaatatggtatcgtaggttggtgcgacgacggcccctaggaacaaggtcttagagtggatgggatggatcgagcgactttaanaagtggtacaagaacctaaatntacgaccacgaacgaacccgtcgaacgggaacaagaacgtcaaacccgtanacgaacccaacgaacgaaccacacaccgaacgacgaccgacggacccttaacgagtacggaccgtacgagggaacncccgttagggaacgtacgttaccgacggaaacgtaccgaaccgggtaccgttaagttacttaaccgtggtacggacggtaaaggtaaggttaaacggttaaacggggttaaattacggttttagaccgttcggttaccccttgtttacgaacgtacggtacggggaccgtaacgggttaacccgtaacgg

SEQ ID NO: 391489 - DNA, 668 bp, Homo sapiens
  misc_feature: GZ8MTXP01ARV2Q.39.81.H04.1.454.CMB.2.raw
  modified_base (360)..(360): a, c, t, g, unknown or other
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttaccaactatggtatctaggttgggtgcgacgacggcccctggacgaagggtcttggaggtggagtgggatggatcgagcgtcttacgaagtcggtacaacaactaaactntcgaccacacgaaccctcgaggacagcgtacaaccagtacgaccaacacgaaccacacgtaccgaacgacgaccgaccggtaccctacacgtcggaacccgtaggaacgggacgtacccgtgggaacgtacgttaccgacgggaacccgaccgaccgggtccggtttaagtaccgttaacgtgtacgggcgaaggaaggttaacgggttaaacgggttaaagtttaggtttacgttaccgtttcggttaccccgtttaagtttccgaacgttacgggtcggggaccgtaaccgggttaacccgttcgg

SEQ ID NO: 391490 - DNA, 586 bp, Homo sapiens
  misc_feature: GZ8MTXP01B19M8.39.81.H04.1.454.CMB.2.raw
  modified_base (250)..(250): a, c, t, g, unknown or other
  modified_base (278)..(278): a, c, t, g, unknown or other
  modified_base (284)..(284): a, c, t, g, unknown or other
  modified_base (340)..(340): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacnctatgatggttcagcagagcagcaatcncaagcnctaattatagttcaacgggctcgtgggccagacagacttcagcggcaggtgggtcnggcactgaattcacactagaaatcagcgagggtggaggacgtagaggtagttggtttaggggtttaattacgtgacgagttaggacgaaagggaaaccaacgtaacgttcgggtacccttaccggttaccgttaaccgttttcgggaccgtaacgggggaacccgaaaggtccgttagggaacgtaagttaaccgaaaacggttaacgtggttacgggccttcggaccacccgtaagttcgtttcg

SEQ ID NO: 391491 - DNA, 602 bp, Homo sapiens
  misc_feature: GZ8MTXP01CTJZE.39.81.H04.1.454.CMB.2.raw
  modified_base (216)..(216): a, c, t, g, unknown or other
  modified_base (358)..(358): a, c, t, g, unknown or other
  modified_base (473)..(473): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctnagtgaaggtctctgcaggtcttcgtgttactaccttaccaatagtggtatcgaggttgggtgcgacgacggcccctggacgaagggtcttggaggtggagtgggatggatcgagcacttacaagtcggtacaacaacaaatntagacccacaacgacctccgaggaaccagcgtacacatacgaccactacgaccacgaacaccaacgacgaccgaccggactacgagtacggacctaggacgacgccagggacgtntccgacggaaccgcgaccggtgtagttacgtcgtggtcgacggaagtaacgaggtaaacgggttatttacgttcgacgttcgttacccttgttacgaacgttcgggcggaccgtaacggaaccgtccgg

SEQ ID NO: 391492 - DNA, 651 bp, Homo sapiens
  misc_feature: GZ8MTXP01ATUHA.39.81.H04.1.454.CMB.2.raw
  modified_base (422)..(422): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttgggtgcgacgacggcccctggacagggcttgagtggagtggggatgggatcaggcgtactttaacgaagttcggtacaacgaactaaaactgtaccgacaacgaacgaaaccctcgaaaggggacaagacgtccaaccatacgaacccaanacgacacactccgaacgacgacgaaccggacctaacgacgtacgggacctagggacgggacgccggtagacgtactcgacggaccgacgaccggtaccgttagtagtacgtggtaggaacggagttaaggtacgggttaacgggttaaatttcgttacggttaccgttaccggttaacccgttagttaacggtacgtacgggacggggtaaccgttaacgggtaacccg

SEQ ID NO: 391493 - DNA, 747 bp, Homo sapiens
  misc_feature: GZ8MTXP01BEMDY.39.81.H04.1.454.CMB.2.raw
  modified_base (272)..(272): a, c, t, g, unknown or other
  modified_base (278)..(278): a, c, t, g, unknown or other
  modified_base (350)..(350): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcgagtgaaggtctcctgcaaggcttctgttacaccttacatatggtatcaggttggngcgacncggcccctggacaagggcttggaggtgagtggatggatcgagcgtcttaacaagtggtacaacaacaaactntcgacccaacacgaacctcgagggaacaagcgtacaacctagtacgacccaacagaacctacactacccgaacggacgacccgtaacggtccttaaccgagttaccgggaacccgttagggaacgggtaccgtacccggtggggtaaacgtacgttacccggtaacggaaacccggaaccggaacccgggggttccgtttaacggtttaacgttaacggttcgggttacgggaacggtaaaggtaggttaaacggggttaaaccgggggttaaattttacggtttacgggttaaccggtttcccgggtttaacccccttttgggtttacccggaaccggttttacccgggacggggggttaccccgttaaccgggggttaacccccgtttaacgggg

SEQ ID NO: 391494 - DNA, 741 bp, Homo sapiens
  misc_feature: GZ8MTXP01CQM22.39.81.H04.1.454.CMB.2.raw
  modified_base (368)..(368): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcattcctttttcttggtggcagcaaacaacaggtcgcccactcccaggttcagctggtacagtctggagctgagatgacgagccgtgggcctgagtgagtctcgtgacaggtcttcgtacgtacctaccttaacaacttatggtatcgtaggttgggtgcgacgcggcccgtaggaacagggtctggagtggagtgggatggactacgagcgtacttaacgagtcggtacaacaactaaactntccgaccaacgacgtaaccctccgaaagggcaaggtacgtacccaaacgtacgtacgaacccaacaacgaaccaacaacacccgaacggaccgacccgtaaccggaccctaacgacggtaccggaaccgtagggaacggaccgccgtaagggacgtactcggaacggaaccggacggtaccggtaccgttagttaaccgttacgtacgggtggaacgggtaaagggaacgggttaaacggttaaaccgggggtttaaaattttcggttttaaccgggttacccgttttaccgggtttaacccctttacggtttaacggttaaccgggtaccgggttaccgggggaacccggttaaaccgggggttaaccccgg

SEQ ID NO: 391495 - DNA, 741 bp, Homo sapiens
  misc_feature: GZ8MTXP01DKI0T.39.81.H04.1.454.CMB.2.raw
  modified_base (188)..(188): a, c, t, g, unknown or other
  modified_base (226)..(226): a, c, t, g, unknown or other
  modified_base (234)..(234): a, c, t, g, unknown or other
  modified_base (253)..(253): a, c, t, g, unknown or other
  modified_base (260)..(260): a, c, t, g, unknown or other
  modified_base (265)..(265): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctgganctgagatgacgaagcgtggggcctcagtgaaggtctcngcagcttntgtacacttacatatgtanctgtggncgacncggcctggacaggtctggagtggatgggatggactcgacggtcgtacttacgagttcggactaacgacgtaaacgttgtacgaccctaaccgtaacggtacccgtacccggagggtaaccctaagggtaaccgttaccgaaacccgtacggtaccgaacccctacgaacgtaaccctaaccgtaacgtccccgaacggggtaactacccggtaacccgggtacctaaccgaggttacccgggaaccgtttagggacggtaaccgtcccgttaaggggaaccgtacgttaccgtcggtaaaccggtccgttaccgggtcgtaaggttccgttaaccgtgggtaccgagggtaaggacgggttaacggttaacggggttaattttacggtttcggaaacccgggtttcgttaacccgttgggttaccgaaccgggttggtacccggggaccgttaacccggggttaaccgtttccggg

SEQ ID NO: 391496 - DNA, 770 bp, Homo sapiens
  misc_feature: GZ8MTXP01CFFW9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttacaccttacactatggtatcagttggtgcgacgacggccccgtggacgaagggtcttggaggtggagtggggatggatcgaggcgtacttaacgaagttcggtaccaaccgtaaactaaaacttacgtacgaccccaaaccgaacgtaaacccgtcccggaaggggaacccaacggtaacggtacccaaacccgagtacggaacccaacgaacgaacctaccaacgtacccgacggaccgaccgacgggtaccctaaccgtaggtaccgggtaccgacgggaacggaccgtacggtacggggaagtacgttcgtaaccggaaccggtacccggtacggtacccggtttagttacgttacggtacggtacggtacgggtaaaggtaacgggttaacggggttaaagggttaaacgttttaacggtttacggttaacccggtttcccggtttacccgtttaaccgttacgggtaaccgttaccggggtacccggggaccggtaaccccggggttaaccgtttaaccccggg

SEQ ID NO: 391497 - DNA, 759 bp, Homo sapiens
  misc_feature: GZ8MTXP01AINOL.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttacctacctttaaccaacttatggtatcgtaggttgggtgcgacgacggtccccgtaggacgaagggtcttggaggtggagtgggatggatcgagcgtacttaacgaagttggtaccaacaacaaactgtacgaacccaaccgaacgtaaacccctccggaaggggaaccaaggtaaccgtaccaaacctaagtaccgaacccaacgaaacgaacccaactaacgtacccgaacggacgacccgaacccggtaccctaacgacgtaccgggaaccgtagggaacggacgtacccgtaggggaacgtaaccgttccgaaccggaaccggtaacccggtaccgggttacccggttagttacgtttacgtacgggtacggaacgggtaaaggtaagggttaacgggttaaacgggggttaaattttacggttttacggaccggtttccggttaccccgtttcgttacggaacccgtttacggggaccggggacccgtaaccgggttaaccccgttcggg

SEQ ID NO: 391498 - DNA, 620 bp, Homo sapiens
  misc_feature: GZ8MTXP01AN2UL.39.81.H04.1.454.CMB.2.raw
  modified_base (277)..(277): a, c, t, g, unknown or other
  modified_base (348)..(348): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtncgacacggcccctggacaagggcttgagtggatgggatggatcagcgcttacaagtggtacacacaaactntgaccacagaacctccaggcagcgtcaacccatcgaccacgacgacacatcccacgacgccgacgacctacagtacggaccgtagacggacgtccgtagggaacgacttcgaacgaccgacgtacggtccgttagttacttacgtaggtcgacggtaaggacgttaggttaacggggttaaatttacggttttacgaccgtttcgggttaaccccttgtttacggaaccgttacggtaccgggggacctaaccggggttaacccgttccggg

SEQ ID NO: 391499 - DNA, 748 bp, Homo sapiens
  misc_feature: GZ8MTXP01CXOY2.39.81.H04.1.454.CMB.2.raw
  modified_base (215)..(215): a, c, t, g, unknown or other
  modified_base (344)..(344): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctctgcaaggcttctgttactacctttacaactatggtatcgtaggttgggtgcgacgacggccccgtaggaacgaagggtcttaggaggtggagtggggatggatcgagtcgtacttanaagtttggaccaacaaactaaacgtgtcgacccaacacgaacccgtccgaaggaacaagaagtaccaacctagtacgaccaacaacgaaccaacacgacccaacggacgaacccgaccggtacctaaccgaggtacggaacccgtggaacgggttacgccgttagggagtaaccgttcgacgggaaccgacccgtaccggtacggttacgttaacgttaccgtggtacggaaccggtaaaggtaggttaaacgggtttaaccgggggttaaaatttttacgggttttacggttaaccggttttcccgggtttaaccccgttttaagtttaccggaaccggtttaacccgggggtccgggggttaaccccgtaacccgggggtttaaccccgtttaacccggggg

SEQ ID NO: 391500 - DNA, 618 bp, Homo sapiens
  misc_feature: GZ8MTXP01DNAX9.39.81.H04.1.454.CMB.2.raw
  modified_base (352)..(352): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacaccttttaccaactatggtatcgagttgggtgcgacacggcccctggacaagggcttggagtggatgggatggatcgagcgtcttacgaattcggtcacaacaaactntcgaccacacgaaccctccgagggacagcgtccaccatcgaccacacgacacataccacgagcacggacctacagtcggacctaggacggacgacccgtagggacgtactcgtacgaaccgaccgaccgggtccgttagttacttacgtgtcggcggaagaggttagtacggggttaaatttagttttcgaacgttcggttacccttgtttacggaaccgttacgggtcggggttaccgtaaccggggttaaccccgttaaccggg

SEQ ID NO: 391501 - DNA, 673 bp, Homo sapiens
  misc_feature: GZ8MTXP01C1D05.39.81.H04.1.454.CMB.2.raw
  modified_base (344)..(344): a, c, t, g, unknown or other
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggtcttctgttacctacctttacaactatggtatcgtaggttgggtgcgacgacggccccgtaggacgaagggtcttggaggtggagtgggatggatcgagcgtactanaagtcggtacaacaacaaactntgaccccacaacgtaccctcgagggaacagaacgtaccaaccataccgaccaacacgaaccacgtacacccgaacgacgaccgaccggacttaacgagtaccggacgtaggacggacgtccgtaggaacgtacgtcgtacggaccgacgccggtcgtagtacgttctggtacgcggaagtagggaaggttaaacggggttaatttttacggtttcggaaccgtttcggtttaaccccgttggtttaccgtaacggtttcccgggacggggttacccggtaaaccggggttaacccgtttaacccggg

SEQ ID NO: 391502 - DNA, 641 bp, Homo sapiens
  misc_feature: GZ8MTXP01DSMWT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaaccaactatggtatctaggttgggtgcgacgacggcccctggaacaagggtcttggaggtggagtgggagtggatcgagcgtacttaacgaagtcggtacaacgaaactaaaactgtacgacccaacgaacgaacccgtcgaagggaacagtcgtaccaaccatacgaccaacgacgaccaacgacacccgaaggacgaccgaacggaccttaacacggtcggaccgtaggacggactccgagggtaacgacttcgacgaacgaccgacggtcgtaggtctacgtgtacgacggaagagttagggtacggttaaattacgtttacggacgttcgttaacccttgtttaagaaccgttacggcggggacctaacgggttaacccgttcgg

SEQ ID NO: 391503 - DNA, 694 bp, Homo sapiens
  misc_feature: GZ8MTXP01DUOPF.39.81.H04.1.454.CMB.2.raw
  modified_base (271)..(271): a, c, t, g, unknown or other
  modified_base (348)..(348): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctctgcaggcttctgttacacctttacaactatggtatcagttgggtncgacaggcccctggacaagggcttgagtggatggggatggatcagcgactttacaagttggtaccacaacaaaactntcgaccaacaacgaaccctacgaggggaccaaggcgtacaacccatcgaaccacgacgaaccacactaccaacggacgccgtaaccgggacccttaacgacgttacgggaacccgtgggaacgggaacgcccgttaggggaacggtaacttccgtaacggaccgaaccgaaccgggtccggttaggttaacttaaccgtggtacggcggaaaggtacgaagggttaaccgggggttaaaatttacggtttttacgaaaccgttcgggttaaacccctttcgtttaacggtaaccgtttaacgggacggggggttaccctaacggggttaacccccgtttaacgggg

SEQ ID NO: 391504 - DNA, 678 bp, Homo sapiens
  misc_feature: GZ8MTXP01AU1E4.39.81.H04.1.454.CMB.2.raw
  modified_base (566)..(566): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaactatggtatcgaggttgggtgcgacgacggcccctgggacgaagggcttggaggtggagtgggatggatcgagcgtacttaacaagttggtacaacaactaaactacgtacgaccctaacaacggaaccctcggaacgggaacaagaacgtccaaccgatacgaaccacaagaaccacgactacccgaaacggacgaccgaaccgggaccctaacgacggtacgggaaccctagggaacgggacgtccgtagggacgtacgttccgacggaaccgaaccgtaccgggtaccgttaggtacttaccgnggtacgacggaaggacggttaggtaacgggttaaatttcgtttacgaccgttcggttaccccttgttacgtaacgttacggtcggggttacccgtaacgggttcccgttcgg

SEQ ID NO: 391505 - DNA, 690 bp, Homo sapiens
  misc_feature: GZ8MTXP01CPNTG.39.81.H04.1.454.CMB.2.raw
  modified_base (385)..(385): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgacaaggtctttcgtaggttaacctaccttttaccaacttagtaggtatcgtaggttgggtgacgacgacggccccgtaggacgtaagggtcttggagtggagtgggatggatcgagcgtacttaacgaagtcggtaccaacgaactaaaactntacgaccaaaccgaacgaacccgtacggaacgggacaagaacgtaccaactagaccgaaccaacgacgaacacacgaccaacggcaccgaccggacctaacgacgttacgggaacccgtagggaacggacgtacccgtagggaacgtaacgtcgacggaaccgtaccgaccggtccgttatacgttccgtaggcgacggaaggtaaggttacgggtaaacggttaaagtttagttacgacggttcgttaccctttaaggttcgtaacgttacgggtcgggaaccgtaacggttcccgttaaccgg

SEQ ID NO: 391506 - DNA, 737 bp, Homo sapiens
  misc_feature: GZ8MTXP01CBO5D.39.81.H04.1.454.CMB.2.raw
  modified_base (216)..(216): a, c, t, g, unknown or other
  modified_base (239)..(239): a, c, t, g, unknown or other
  modified_base (256)..(256): a, c, t, g, unknown or other
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctnagtgaaggtctctgcaggtcttntgttactaccttacatntgtatcgtagttggngcgacgcggcccgtggacgaagggtcttggagtggagtgggagtggatcgagcgtacttaacgaagttcggtaacaacaactaaaactgtacgaacccaacgtaacgaacccgtaccggaacggggtaacaacgtaacgtacccaaaccgtagtaccgaaacccaacgaaacgaacctaaaccacacccgaacggaaccgaccgaaccggaccccttaaacgcgtaacgggaccgtagggaacgacgtaccgtagggtaacggtactccggtaacggaaccgaccgaccggttacggttacgttacgttacgtagggtacgaacgggtaagtaacgggttaaggttaacgggttaaaacgttttacgttttacgggttaaccgtttcgggtttaacccctttggttaccgtaaccggttaccggggtcgggaacccggttaacgggttaaccccgtttaacccggg

SEQ ID NO: 391507 - DNA, 674 bp, Homo sapiens
  misc_feature: GZ8MTXP01BXVQJ.39.81.H04.1.454.CMB.2.raw
  modified_base (403)..(403): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaactatggtatcaggttgggtgcgacacggcccctggacaagggcttgagtggatgggatggatcgagcgcttaacaattcggtacacaacaaactatcgacccaacaacgaaccctccgaaggggaccaagcgtcaaccatacgaccanacgacacactaccacgagccacggaccctacgagtcgggacctgggacggacgtcccgtaggggaacgtactccgtacggaaccgaaccgaccgggtaccgttaggttaactttaccgtaggttcggacggaaggtaacggttaacgggttaccgggggttaaaattttacggttttacggaaccggtttcgggttaacccctttcggttttacggaaccgtttaccggggcgggggttacccgtaaccgggggttaacccgtttccgggg

SEQ ID NO: 391508 - DNA, 671 bp, Homo sapiens
  misc_feature: GZ8MTXP01DJ79S.39.81.H04.1.454.CMB.2.raw
  modified_base (351)..(351): a, c, t, g, unknown or other
  modified_base (395)..(395): a, c, t, g, unknown or other
  modified_base (413)..(413): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacaactatggtatcgagttgggtgcgacacggcccctggacaagggcttgagtggatgggatggatcgagcgcttaacaaagtcggtcaacaacaaaactntgacccacagaaccctcgaagggcagaacgtcaccatcgaccanagactacgactccaacgngtacaaccggcctaacagtcggacctggaacggaacgtcccgttaggggaacgtacgttaccgtacggaacccggacccgtaaccggggtcccgtttaagttaacgtttaaccggttggacggtaccgggaaggtaagggttacggttaaaccgggggaaattttacggtttacggaccgttttcgggttacccctttggttttaacgaaccgtttacgggtcgggggacccgtaacggggttaaccccgtttccggg

SEQ ID NO: 391509 - DNA, 713 bp, Homo sapiens
  misc_feature: GZ8MTXP01B7FYH.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctgttacacctttaccaatatggtatcagttggtgcgacgacggcccctggacgaagggtcttaggagtggagtgggatggatcgagcgtacgtttacaagttggtaccaacgaacaaaactatacgacccaacacgaacccgtccgagggacagaacgtcaccatacgacccaacacgaaccacgactacccaacggacgaccgaaccggacccttaacgagtaccgggacccgttggaacgggacgacccgttaggggaacgtacgttaccgtacggaaccggacccggtaaccgggtccgttaacggtttaacgtttaccgtgggttacggccggtaaagggtaaggttacgggttaacgggggttaaacttttaggttttacggttaaccgtttcgggttaaccccttttgtttacggtaaccgttcgggccgggggttacccgtaaaccggggttaaccccgttccggg

SEQ ID NO: 391510 - DNA, 687 bp, Homo sapiens
  misc_feature: GZ8MTXP01CPV4L.39.81.H04.1.454.CMB.2.raw
  modified_base (365)..(365): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccggcctccatctctgcaggtctagtcaaagcctagtatactattgataggaaactacttacttagaatttggttcagcaggacgccaggccaatctacaaggctacttaatttataacggtttcaaccggctcgtacgggtaccagactagtactcgaggccggnaagggttcgggcagggacctagttagaacttcaaactacgtaagaaaatccgaaggacgtaaggggtcggaaggtacgttagggaagggtagtttacggggtttaggggttttaacttacggtagggtactaacggttacgaaaccggtaaaggaaacccacgtaaccggttcccggtacccgtttaacccggttaacgttaccgggttttaaccggggaacccggtaaacgggggttaccctaaagggttaccgttaaggggaacttaaacgttaaccgaaaacgtaacgtggtaacgcgtcgacctaaccttaagttccg

SEQ ID NO: 391511 - DNA, 678 bp, Homo sapiens
  misc_feature: GZ8MTXP01A9AP7.39.81.H04.1.454.CMB.2.raw
  modified_base (374)..(374): a, c, t, g, unknown or other
  modified_base (633)..(633): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggtcttctggttactacctttaccaacttatggtatcgtagttgggtcgacgacgacggccccgtaggacgaagggcttgaggtggagtgggatggatcgagcgtactttaacgaagtggtacaacgaaacctaaaacgttanacggaaccccaacaacgaacccgtaccgaacggggaccaaggtaacgtacccaaaccgacgtacgaaccaacgacgaaacctacactaccgaacgacgaccgaccggaccctacgcgtacggacctaggaacggacgacccgtagggacgtacttcgacggaaccgaccgtacgggtaccgttagttacttacgtgtacggacggaagtgttaagggtaccgggttaaatttcgttttacgacgttccgggttaccttnttacggaacgtacgggttcgggaccgtaacggttaacccgtccgg

SEQ ID NO: 391512 - DNA, 603 bp, Homo sapiens
  misc_feature: GZ8MTXP01DMPTD.39.81.H04.1.454.CMB.2.raw
  modified_base (288)..(288): a, c, t, g, unknown or other
  modified_base (416)..(416): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagaggccaggccaatcncaagcgacctaaattataaggtttctaaccgggatcgtggggtcccagacagacttcgagcggctaggtcgggtcaagggcaacgtagaaacttccgaacactagaaaactcaagcgagggtggaggngtagaaggtagtggtttaggggtttattacgtgtacgtaagttggaacgtaaacgggaaacaacgacgtcggtacccttccgttaactacgttttcggacccgtaaggggtaccaaaggtccgttagggaagtaagttaaccgaaaacggttaacgtggtacggcgtcgaccacctaagttccgttg

SEQ ID NO: 391513 - DNA, 602 bp, Homo sapiens
  misc_feature: GZ8MTXP01DVSRD.39.81.H04.1.454.CMB.2.raw
  modified_base (350)..(350): a, c, t, g, unknown or other
  modified_base (423)..(423): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgtactaccttacaatatggtatcgagttggtgcgacacggcccctggacgaaggcttagagtggagtgggatggatcgagcgtacttacgaattggtacaacaacaaactntcgaccacaagaccctcgaggacagcgtacacagtacgacacagacacactaccgacgagaccgacgacctanacgtcggaccagaacggacgcctagggaagtacgtcgtaacgaccgtaaccgaccggtccgtagttaacttcgtggtcgacggaagaggttacggtaagggttaaatttagtttagacgttcggttacccttgttacgtaacgtacgggtcgggaccgtaacgggttaacccgtccggg

SEQ ID NO: 391514 - DNA, 689 bp, Homo sapiens
  misc_feature: GZ8MTXP01CJX2F.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgacgaaggtcttcgtcggttacctaaccttttaaccaacttagtggttatcgtaggttgggtcgcgacgacggccccgtaggacgaagggcttggaggtggagtgggatggatcgagcgtacttagaagttggacctaacaactaaaactagtcgacccaacgaacgaacccgtcgaagggacaagcgtaccaaccagtacgaaccaacgagaacctacacgtaccaacggcgaccgaaccggtacctaacgacgtacggaacccgtaggaacggaagtcccgtagggaacgtacgttaccgacggaaccgtaaccgtccgggtccgtttaagttaccgttaacgtggtacggacggaagtaacggttaggttaaacgggaattttacgttcgttaccgttcgttaccctttgtagtaaccgttacgggtcgggaccgtaaccgggttaaccgttcggg

SEQ ID NO: 391515 - DNA, 702 bp, Homo sapiens
  misc_feature: GZ8MTXP01BBNWL.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaacgccgtgggcctcgagtgaaggtctcgtgcaagtcttctgttacctaccttacatatgtatcgtaggtggtgcgacgacggcccgtaggacgtaaggtcttggaggtggagtgggatggtactcgagcgtacttaacgagttcgtacaactaaacgtaaactgtcgaccccaacgaacgaacccgtacgaacgggaacaacggtaactaccaacctaagaccgaaccaacgaacgtaccacactacccgaagtcacccgacggtacccaagtacgcggtacgaggacggacgccgtagggaaacgttcgaccgacgggaacccggacgtaccgggttacgttattacgttaccgaggtacggaacggaaagtaacgggttaacgggtttaaacggttaaattttcgggttaaccggaaccgtttcggtttacccctttggttaaccggtaaccgttcgggggtaccgggacccggttaaacccggttcccgtttccggg

SEQ ID NO: 391516 - DNA, 665 bp, Homo sapiens
  misc_feature: GZ8MTXP01AG2P0.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatcctcctgcaggtctagtcaaagcctcgtatacattgatggaaacactacttgaattggttcagcagacggccaggccaatcctaccgaaagggtccgtacctttaaaagtttacgttaaacgggttttaccgtaaacccgggggtacttccggtcgggggtaccccaaggaccagtacttccgaggcggcgtaggtcgggtcaaggcacgtgaacttcacactagaaatcgagcgagggtgaggcgtggaggtagttgggttaggggtttaattacgtgtacgtagtaggacgaaagggaaccacgtacgttcgggacccttaccggttaacgttaccgtttacgggacccggtaacgggggaacccaagggtaccgttaggggaaacgtaacgttaaccgaaaaccgggttacgtcgggttcgggaaccttacggaccttacgtaacgttccgttccg

SEQ ID NO: 391517 - DNA, 689 bp, Homo sapiens
  misc_feature: GZ8MTXP01EWEHI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctgttacacctttaccaactatggtatcgaggttgggtgcgacgacggcccctggacgaagggtcttggagtggagtgggatggatcagcgtacttacaagtcggtacaacaacaaaatactcgaccaacgagaacccgtccgaaggggaaccaagaacgtacaaaccctagtacgaaacccaacgaacgaacccaactaactacccgaaacgacgcccgaaccgggtaccctaacaacgtacgggacctacgggaacgggaccgccgtagggaagtacgttacgaacggaacgaaccgaaccggtcccgttaggttaacttacgtgtacggacggaaggtacggttaaggtacggggttaaaatttcgttttaacggaacgtttcggttacccctttgtttagtaaccgtacgggttacggggaccgtaacggggttaacccttccgggg

SEQ ID NO: 391518 - DNA, 574 bp, Homo sapiens
  misc_feature: GZ8MTXP01DOFS1.39.81.H04.1.454.CMB.2.raw
  modified_base (267)..(267): a, c, t, g, unknown or other
  modified_base (404)..(404): a, c, t, g, unknown or other
  modified_base (423)..(423): a, c, t, g, unknown or other
  modified_base (472)..(472): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgtacactttacatatggtatcagttggncgacaggcccctggacaagggcttggagtggatgggatggatcagcgcttacaatggtacacaacaaactatcgaccacaacgaacctccgaagggaccagaacgtcaaccatcgacccatagacacatccaacgancacggcctacatcggaccngacggacgccgtagggagatcgacgacgacgacggccgtatacttacgngtgacgaagacggagtacggggttaaattagtttcgacgttcggttaccttcgttacgtaaccgttaacgggtcgggaccgtaacgggttaacccgttcggg

SEQ ID NO: 391519 - DNA, 692 bp, Homo sapiens
  misc_feature: GZ8MTXP01CAG20.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggtcttcgtgttacctacctttaaccaactagtggtatcgtaggttgggtgcgacgacggccccgtaggacgaagggtcttaggaggtggagtgggatggatcgagcgtacttaacgaagttcggtaccaaacaaacgtaaaactatcgaaccccaacgaacgaaccctccgaaggggaacaaggtaacgtacaaccctagtacgaaccaacaacgaaccacaactacccgaacgacgaccgaaccggtacctaacgacgttacgggaccgttaggaacggtacgccgtagggacgtactacgacggaaccgaccgccggtaccgttagttacgttacgtggtcgacggaagtacggttaggttaacgggttaaatttacgtttacgttaccgtttcgttaccctttgttacgtaacgttacggtcggggacccgtaaccgggttccgttaaccggg

SEQ ID NO: 391520 - DNA, 640 bp, Homo sapiens
  misc_feature: GZ8MTXP01AQSMF.39.81.H04.1.454.CMB.2.raw
  modified_base (541)..(541): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttcgtgttactacctttaccaactatggtatcgaggttgggtgcgacgacggccccgtggacgaagggtcttggaggtggagtgggataggatcgagcgtactttacaagtcggtacaacaactaaactgtacgacccaacaacgtaaccctccgagggaacaagcgtacaacccatacgaaccacgaacgaaccactaactaccgaacgacgaccgaaccggtacctaacgacgtacggaccgtaggaggaccgccgtaggacgtactaccgtacggaccgtacgaccggtcgttagtattcgngtacggcgaagtaggttacggttacgggttaaattcgttacgccgttcgttacccttgttacgaacgtcggtacgggaccgtaacgggttaaccgtcgg

SEQ ID NO: 391521 - DNA, 675 bp, Homo sapiens
  misc_feature: GZ8MTXP01A1L6V.39.81.H04.1.454.CMB.2.raw
  modified_base (373)..(373): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttactacctttaccaacttatggtatcgtaggttgggtgcgacgacggtccccgtggaacaagggcttaggaggtggagtgggatggatcgagcgtacttacgaagttggtaccaacaacaaaacgtntacgaccaacgaacgaaccctcgaacgggtacaaggtaacgtacccaaccatacggaaacccacgaacgaaccacactacccgacgacgaccgtaaccggaccttaacgagttaccggaaccgttagggaacggacgtacccgtagggaacgtacgtaccgtcggaaccgaccgaccgggtccgttagtacgttacgtggtacgaacgggaagaagttacggtaaggggttaattagtttacgttacgttcggttacccttgttacgtaacgtcggtcgggaccgtaacgggttaacctcgg

SEQ ID NO: 391522 - DNA, 707 bp, Homo sapiens
  misc_feature: GZ8MTXP01CPVFZ.39.81.H04.1.454.CMB.2.raw
  modified_base (589)..(589): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctctgcaaggcttctggttactacctttaccaactatggtatcgtaggttgggtgcgacgacggcccctggacgaagggtcttgaggtggagtgggatggatcgagcgtacttaacgaagttcggtacaaacgaacaaaacttatacgacccaaccaacgaacccgttacccggaacggggaaacaacggaacgtaccgaaacccagtacgaaacccaacgaaacgaaccaaccactacccgaacggacgacccgaaccggacccttaacgacgttaccgggaccgtacgggaagggaccgtcctaggggaacgtacgtacgtacggaaccggtaacgccgggtaccgttagttacgttacgnggtacgcggtaagaacggttaggtaacgggttaaagtttcgtttacgacgtttccggttaacccttcgttacgtaaccttacgggcggggttacccgtaacgggttaacccgttccgg

SEQ ID NO: 391523 - DNA, 659 bp, Homo sapiens
  misc_feature: GZ8MTXP01D0DQB.39.81.H04.1.454.CMB.2.raw
  modified_base (213)..(213): a, c, t, g, unknown or other
  modified_base (233)..(233): a, c, t, g, unknown or other
  modified_base (269)..(269): a, c, t, g, unknown or other
  modified_base (344)..(344): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcgtgggctnagtgagtctctgcagtcttntgttacaccttacatatgtatgtaggtggtgcgacncggcccgtaggacgaggtctggaggtggagtggagtggatcgagtcgtacttaagagtcgtacaacaacaaactnacgaccaacacgaacctcgaggaacagcgtacaacacgacgaaccacgaacaccacgactaccgaacgacgaccgaccggtacctaagacgtacgggaacgtagggaacgacgtcccgttagggaacgtcgtaccgaggaacccggtaccgtaccggtcggtttaagttacgttacggtggtacggaacggtaaggtaaggttaacgggttaaacgggttaaattttacgggtttacgttaccggtttcgtttaccctttggttacggaaccggtttacgggcggggttacccgtaaccgggttaacccgttcgg

SEQ ID NO: 391524 - DNA, 670 bp, Homo sapiens
  misc_feature: GZ8MTXP01DS1B9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttacaccttacaactatggtatcgtaggttgggtgcgacgacggcccctggacgaagggtcttggaggtggagtgggatggatcgaagcgtacttaacgaagttggtaccaacaacctaaaactgtacgaccaaccaacgaaccctccgaaggggaccaagcgtaccaaccatacgaaccacacgacacactccaacgacgccgaaccggacctacacgtacggaccctaggacggacgtcccgtaggggaacgtactccgtacggaccgaccgtacggtccgttagttattacgtggtggacggaaggtaggttacgggttacggggttaaattttacggttttcgaaccggtttcggttaaccccgtttgtttacgggtaaccgttacgggccgggggttacccgtaaccggggttaaccccgttccgg

SEQ ID NO: 391525 - DNA, 674 bp, Homo sapiens
  misc_feature: GZ8MTXP01B1B9L.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcgtggggcctcgagtgaaggtctctgacaaggtcttctgttactacctttaccaactatggtatcgtaggttgggtgcgacgacggccccgtaggacgaaggtcgttaggaggtggagtgggagtggatcgagcgtacttacaagtcggtacaacaacgtaaactatacgaccaacaacgaacccgtccgaagggacaacgcgtaccaaccatacgaaccacaagaccacactaccgacgacaccgacggaccctaacgacgtacggaccgaggaacggaacgccgtagggacgtacgttaccgaacggaaccgtaaccgaccgggtaccgttagtttacgttaacgtggtacggacggaaaggtaaggttacgggttaacgggttaaattttcgtttagttaccgttcggttaccccttgtttaccgaacgttacgggcgggttacccgtaaccgggttaaccgtccgg

SEQ ID NO: 391526 - DNA, 707 bp, Homo sapiens
  misc_feature: GZ8MTXP01DJG2V.39.81.H04.1.454.CMB.2.raw
  modified_base (268)..(268): a, c, t, g, unknown or other
  modified_base (273)..(273): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggtcttctgttactaccttacaatatgtatcagtggtncgacncggccctggacgaagggtcttggagtggagtgggatggatcgagcgtacttacaagttggtaccaacaaccaaactatacggacctaccaaagaacccctaccgaggggaacaaggtcgaccaacccatacgaacccacgacgaaccacgactacccaacggacgaccgaacccggaccctaacgagttaccggggaaccctgggaacgggactcccggtaggggaaacgcgtttaccgacgggaaacccgaaccggacccggtacggtttacgttaagtttaccggtggcgggaacggtaaagggtaacggttaacgggttaaacgggggtttaaattttacggttttacgttaacccgtttcgggttaaccccttgtttaaccggaacgttaccgggcggggttaccctaacgggggttaaccccgttcggg

SEQ ID NO: 391527 - DNA, 682 bp, Homo sapiens
  misc_feature: GZ8MTXP01BZ5XP.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggtcttctggttacacctttaccaactatggtatcgagttgggtgcgacgacggcccctgggacgaagggtcttaggaggtggagtggggatggatcgagcgtacttacgaagttcggtacaacaacaaactatcgaccacagaaccctcgaggacagcgtcacatcgaccacagacactactccacgacgccgaccggacctaacgacgtacggaccgtagaacggacgacccgttagggaagtcgtacgtacggaccggaaccgtacgggtacccgtagttacgttaccgtacgtcggaccggtaaggtaacggttaggttaacgggggttaaagtttacggttttcggaaccggtttcccgggtttacccttaacgtttccgggtaaccttaaccggggtccgggggttaacccggtaaccggggttaaaccccggtttcccggg

SEQ ID NO: 391528 - DNA, 610 bp, Homo sapiens
  misc_feature: GZ8MTXP01BL5Q6.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactattgaattggttcagcagacggccaggccaatctacgaaggcgaccttaaatttataacggtttcaaacccgggtacttcgtacgggggtcccagaccagacttcagcggcaggtgggtcaaggcaactgaaacttcaacactagaaatcgagcgagggtggaggacgtaggaggtagttggttaggggtttattacgtgtacgagtacggacgaaagggaacacgaccgtacggtaccctaccgttaaccgtacgttttacgggaccggtaacggggtaaccgaaagggtcgttagggaacgtaacgttaacgaaacgttaacgtggtacgggctcggacttaccgtaacttcgttcg

SEQ ID NO: 391529 - DNA, 684 bp, Homo sapiens
  misc_feature: GZ8MTXP01C648F.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacaactatggtatcagttgggtgcgacaggcccctggacaagggcttgagtggatgggatggatcgagcgacttaacaagttggacaacaacaaaactatacgacccaacaacgaaccctccgaaggggaccaagaacgtaccaaccaatacgacccaacgacgacacaactcccaacgacgacctaacgggaccctaacgagtacggaccctaggaacggaacgcccgttaggaacggtacttaccgtacggaacccgaaccgaccggggtacccgttaggttaactttaccgtggtacgacggaaaggaaggttacggttaacggggaaaattttacgttttggttaaccgtttcgggttaaccccctttgtttacggtaaccgtttacgggtcgggggttacccgtaacggggttaaccccgtttccggg

SEQ ID NO: 391530 - DNA, 646 bp, Homo sapiens
  misc_feature: GZ8MTXP01DKXBD.39.81.H04.1.454.CMB.2.raw
  modified_base (357)..(357): a, c, t, g, unknown or other
  modified_base (378)..(378): a, c, t, g, unknown or other
  modified_base (409)..(409): a, c, t, g, unknown or other
  modified_base (424)..(424): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgacaaggtcttcgtacggttactaacctttaaccaacttagttggtatcgtaggttgggtcgacgacgacggccccgtaggaacgaagggtcttggaggtggagtgggatggatcgagcgtacttanaagtcgacaactaacaaactntgacccacacgacctcgaggacagcgcacancacacagacactacnccgaacgacgaccgaccgactacgagtacgacgtagacgggactcgtagggaagtacgtcgacggaacgaccgtacggtacgttattacgtcgtgtacggacggaaaggtaggttaacgggttaaacgggttaaattttcggttacgttaccgttccgtttacccgttgttacgtaaccgttacggggtacgggttacccgtaaccgggttaacccgtccgg

SEQ ID NO: 391531 - DNA, 664 bp, Homo sapiens
  misc_feature: GZ8MTXP01CIUNS.39.81.H04.1.454.CMB.2.raw
  modified_base (216)..(216): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaggtctcctgcaaggtcttcgtggttaacctaccctttaccaacttagtggtatcgtaggttgggtgcgacgacggcccctaggacgaagggtcttggaggtggagtggggatgggatcgagccgtacttaagaagtacggaaacaacaaagtatacgacctaactaattaacgtttcccggaaaggggtacctaaggtcgtactaaactactaagtaccgaaaccaacgaacgaaccaactactaccgacgaacgccacttacgaccttaacgagttacgaacgtaggaacgtaaccggtgaacgtactacgacggaccgtacggaaccgtttctttaacttaagttttagtcgtaggaacgaaggttaacgtaaacttaacgtttccctacttacgttaattcgttaacgagtaagtaggttagttacgttctttgttttcg

SEQ ID NO: 391532 - DNA, 705 bp, Homo sapiens
  misc_feature: GZ8MTXP01ER3XS.39.81.H04.1.454.CMB.2.raw
  modified_base (573)..(573): a, c, t, g, unknown or other
tcagtcgcactagtcacgaccggtgctcgattttagtagtgtagattcgcggggcacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggtcttcgtggttacctacctttaaccaactagttggtatcgtaggttgggtcgcgacacgggtcccctaggaacgtaagggcttaggaggtggagtggggatggactcgagcgtactttaacgaagttggtacaaacaacgtaaactagtaccgacaacgaacgaaccctccgaaagggacaaggactaccaccgatacgaccacaacgaccaacactaccgaacgaacgaccgaaccggtaccctaacgagtaccggaacctagggaacgggacgtccggtagaacggtattacccgaggacccggacgtaccgggtaccgttgtaaactttcgngggtagaacggtaaggttaggtaacggttacggggtaaatttacggtttacggttaccgtttaccggggttaaccccttgtttaacggaccgttacgggttccgggggtaacccgttaacggggtaaccccg

SEQ ID NO: 391533 - DNA, 730 bp, Homo sapiens
  misc_feature: GZ8MTXP01C8D69.39.81.H04.1.454.CMB.2.raw
  modified_base (580)..(580): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaaaaggtcttctgttactacctttaccaactatgtatcgtagttgggtgcgacacggccctggacgaagggtcttggaggtggagtgggagtggagtcgagcgtacttacgaagttggtacaacgaactaaactatacgacccaacgaacgaccctaccgacgggaacaggaacgtaccaaccgtagtacgaaccaacgaacgaaccacgactacccgaacggacgacccgaaccggacctaacgacgttaccgggaaccgtagggaacggaaccgtcccggttagggaacggtacttaccggacggaaaccggaccgtaccgggttccgtttaggtaactttaccggnggttacggacggaaagggtaagttaacggggttacggggttaaaattttacggttttcggaaaccgtttcgggttaacccctttggttttaccggaacgtttaacggggccggggttaaccgtaacccgggggttaacccgtttcccggg

SEQ ID NO: 391534 - DNA, 553 bp, Homo sapiens
  misc_feature: GZ8MTXP01BNNQY.39.81.H04.1.454.CMB.2.raw
  modified_base (350)..(350): a, c, t, g, unknown or other
  modified_base (515)..(515): a, c, t, g, unknown or other
  modified_base (532)..(532): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctcctgcgagtctagtcaaagcctagtatacattgatagaaactactacttagaattgtcagcagagcaggaccatctacaggctacttaatttagtaagttacgtaaccggactcgtcggggtccagacagacttcgagcggngagtgggtacaggcatagaacttacgaactaacgtagaaaatcgagacggaggggtaggaggcgtagggaggtagtttagggtttaggggtttattagtgacgtagtagaacgaagaacacgacgtcgtcctacgtactacgtttcggccgaaggtaaccagcgngagactacaagcttggntctgcctacattcgttcgttc

SEQ ID NO: 391535 - DNA, 725 bp, Homo sapiens
  misc_feature: GZ8MTXP01B2M7K.39.81.H04.1.454.CMB.2.raw
  modified_base (308)..(308): a, c, t, g, unknown or other
  modified_base (317)..(317): a, c, t, g, unknown or other
  modified_base (427)..(427): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccactcccaggttcagctggtacagtctggagctgagatgacgagccgtggcctcgagtgaaggtctcgtgacgaagtcttcgtagttacctacctttaacaactgtggttatcgtaggttgggtgcgacgcggccctaggacgaggntgagtgagnggatggatgagcgtacttacaagtcggtacaaacaacgtaaacttagacgaacccaacgaaccggaaaccctccggaacgggaacaaacggtaaccgacctaaaccgtanaaccgaaacccaacgaacgtaaaccaacccgacgaaccgaacgacgacccgttaacccgacctaacgagtaccggacgtacgggagtacgtccgtagggaagtccgttacgaccggaaaccggccggtaccggtaccgggttacttaacgttaccgtggtacggcgaaagggtacggttaacgggttaaggttaaagtttcgtttaacgttacggtttcccggttaaccctttcggtttaaccggtaaccgttaccggggtaccggggaccgtaaccggggttaaccccgttcccggg

SEQ ID NO: 391536 - DNA, 744 bp, Homo sapiens
  misc_feature: GZ8MTXP01CNENJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttcgtgttacacctttacaactatggtatcgtaggttgggtcgcgacgacgggcccctaggacgaagggcttggaggtggagtgggatggatcgagcgtacttacaagttgacaacaacaaactgtagacccaacacgaacctcgaggacaagcgtacaaccatacgaaccaacaacgacctaacgactaccgaacggacgaccgaacccgggtacccttaacgacgttcgggaaccgttacgggaacgggacgtaccggttaggggaacggtactttaccgggaccggaaaccggtacccggtaccgggttaccgtttacggttacgtttaaccgtgggttacgggacggtaacgggtaaacgggttaacgggtttaaaccgggggttaaatttttacgggtttacgttaaccggtttcccgggtttacccctttaaggttttaccggaaccgtttacgggggtaccgggggttacccggtaaaccgggggttaaccccgttaacggg

SEQ ID NO: 391537 - DNA, 595 bp, Homo sapiens
  misc_feature: GZ8MTXP01DRT5P.39.81.H04.1.454.CMB.2.raw
  modified_base (253)..(253): a, c, t, g, unknown or other
  modified_base (267)..(267): a, c, t, g, unknown or other
  modified_base (345)..(345): a, c, t, g, unknown or other
  modified_base (385)..(385): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgggatgacgaagcctggggcctcagtgaaggtctcctgcaggcttctgttacacttacaatntggtatcagttggncgacaggcccctggacaagggcttgagtggatgggatggatcgagcgtactttacgaagtggtacaacaacaaactangacaaccagaaacctcgaagggcaaagacgtcaacctaanacacaacacacacacacaacgacgaccgaacgactaacgagtacggacaggacgcacgagaggtactcgacgaccgaacgacggtcgttagtacttcgtgtcgacggaagaaggtaacggttagggtaaatttgttacggtaccgttcggttacccttacgttaacgacggtcgggtaccgggacgttaaccggtaaccgttcggtaacc

SEQ ID NO: 391538 - DNA, 711 bp, Homo sapiens
  misc_feature: GZ8MTXP01ELTZ9.39.81.H04.1.454.CMB.2.raw
  modified_base (215)..(215): a, c, t, g, unknown or other
  modified_base (440)..(440): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaagtctctgcaagtcttctgttactaccttacaactatggtatcgtaggttggtgcgacgcggccctggacaagggctgagtggagtgggatggatcgagtcgtcttaacaaagttcggtaccaactaaactaaactagtacgaccaacgacgtaaacccgtccgaaggggaaccaaggcgtacccaaaccgaacgtacgaaccaacgaacgaacactacncccgaaacgagacccaaccgggtacccttaaacggagtacgggaacccgtagggacggtaacgaccgtaggggaacgtattccgacgggaaaccgacccggtcgggtaccgttagttaacgtttaccgtggtcggaccgggtaaaggtaacgggttaaacgggttaacggggttaaaatttggttttacgaaccggtttccgggttaccccttaagtttcggaaccggttacgggcgggggaccccgttaacggggttaaccccgttcggg

SEQ ID NO: 391539 - DNA, 550 bp, Homo sapiens
  misc_feature: GZ8MTXP01EUA8B.39.81.H04.1.454.CMB.2.raw
  modified_base (284)..(284): a, c, t, g, unknown or other
  modified_base (353)..(353): a, c, t, g, unknown or other
  modified_base (422)..(422): a, c, t, g, unknown or other
  modified_base (438)..(438): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggatgttgtgatgactcagtctccagtctccctgccccgtcacccttggacagccggcctccatcctcctgcaggtctagtacaaagcctcgtatacattgatggaaacactattgaatggttcagcagagcagcaatcncaagcactaatttataaggtttcaaccgggactcgtgggtccagacagacttcagcggcaggtgggtcnggcactgaattcacactagaaatcagcgagggtggagcgtggagtagttggttgggttaattacgtganagtgacgaaaggaacncgacgtcggaccttaccgtactacgtttcggacgaaggggaccttaaaggcgttagggaataacgttaacgaaaacgaacgttggcggaactggaccaccgtaagttcttcg

SEQ ID NO: 391540 - DNA, 673 bp, Homo sapiens
  misc_feature: GZ8MTXP01AH2YK.39.81.H04.1.454.CMB.2.raw
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcacccatggactggacctggagcatccttttcttggtggcagcaacaacaggtgcccactcccaggttcagctggtacagtctggagctgagatgacgaagccgtggggcctcgagtgaaggtctcctgcaaggcttctggtacaccttacaactatgtatcgaggttggtgcgacgacggcccctaggacgaagggtcttggaggtggagtggggataggactcgaggaccgtcgttaacgaagtcggtacaacaactaaactntacgacccaacgacgaacctaccgaggacagaacgtcaaccatacgaccacaacgacacgtactaccgacgagaccacggacctacacgtacggaccgtaggaacggacgaccgtaggggaacgtacgttcgacggaaccgaccgtaccgggacccgtttagttaacttacggtcggtacggacggtaaggaacggttaggtaaaccggggttaaatttacggttttacgacccgtttacgggttacccttggttacgaaccgttacgggtcggggttaccgtaaccgggttaacccgttccggg

SEQ ID NO: 391541 - DNA, 773 bp, Homo sapiens
  misc_feature: GZ8MTXP01AZSGO.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctgttactacctttacaactatggtatcgaggttgggtgcgacgacggcccctggacgaagggtcttggagtggagtgggatggatcgagcgtacttaacaagtcggtacaacaactaaactgtacgaccccaacgaacgtaaccccgtccgaacggggaacaacggtaacgtaccaaacccaagtaccgaaacccgaacaaacgaaccacgtaactacccgaaacgacgaccgaccggtaaccctacgacgtacgggaacccttagggaacggtacgcccgtaggggaacgtacgttaccgacggaaccgaccccgtccggggtacccgttaggtttaaccgttaccgggtaggtaccggaacgggaaacgggtaacgggttaaccggggttaaaaggtttacgtttttaaacgggttaaccccggttaccgggtttaccccgtttaccggttttaaccgttaaccggtaaccgggttacccgggggtaccgggttaacccggggtaaccccggttaaccgggttaaccccgg

SEQ ID NO: 391542 - DNA, 731 bp, Homo sapiens
  misc_feature: GZ8MTXP01DFXZ1.39.81.H04.1.454.CMB.2.raw
  modified_base (382)..(382): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcgaaggtcttcgttagttacctaccctttaaccaacttagtggttatcgtaggttgggtgaccgacgacggccccgtaggacgaagggtcttaggaggtggagtgggatggatcgagtcgtacttaacgaagttggtacaacgaacaaactntcgaccacaacgacctcggaggacaagtcgtaccaaccgatacgaacccaacgacgaaccaactacgacccgaacggacgtacccgaaccgggtacctaacgacggttaccgggaaccgtagggacggacgtcccgtagggtaacgacttacggaccgaacgacccggtaccggtcgttaacgttacgttacggtacgtcggaacggaaggtaaggttaacgggttaaacggggttaaattttaacgggtttagttacccggtttcggttaccccgtttaacgtttaacggtaaccggttacggggtaccggggttacccgggtaaccgggttaacccggtttcccggg

SEQ ID NO: 391543 - DNA, 703 bp, Homo sapiens
  misc_feature: GZ8MTXP01A4IZH.39.81.H04.1.454.CMB.2.raw
  modified_base (461)..(461): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctggttactacctttacaactagtggtatcgaggttgggtgcgacacggcccctggacaagggcttggagtggagtgggatgggatcgacgtcgtactttaacgaagttgggtaccaaacgaaacctaaaactagtacgaccctaaccgaaacgtaaccccgtaccgaacgggggaacccaaggaacgtacccaaaccacgtacgacccaacgaacgacccanacctaccgaacgacgaccacggacctacgagtcgggacctaggaacggagtaccctggggaacgtacgttacgacggaaccgacccgtaccggtacgttacgttacgttaccgtggtacggacggtaagggaacggttacggttaacggggttaaattaggtttacggttaccgttcggtttacccctgttttaccgaaccggttacgggtccggggaccgtaaccgggttaaccgttccgg

SEQ ID NO: 391544 - DNA, 754 bp, Homo sapiens
  misc_feature: GZ8MTXP01CDD2B.39.81.H04.1.454.CMB.2.raw
  modified_base (273)..(273): a, c, t, g, unknown or other
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgaaggtctctgcaaggtcttcgtgttactaccttacaatgtgtatcgaggttggncgacgacggccctggaacgagggcttaggaggtggagtggggatggactcgacgtcgtacgttaacgaagttcggtaaccaaaccaaactaaacgtntacgaaccccgtaaccgaaacgaaccccgtaccggaagggaaacctaacgggccgtaaaccaaaccccgtaaagccgaaaccccgaacgaaacggaacctaaccaccgtacccgaacgacgaccgtacccggaccttaaccgagttaccggaaccgtggaacggacgtccgtaggggacgtacgttaccgacggaaccgtaccggaccgggttacgtttacgtacttaaccggttgaccggtagggaaaggacggttaacgggttaacgggttaaattttacgggtttacggttaaccgttcccgggttttaacccttcggtttacggaacccgttacggggtcccggggttacccgtaacccgggggttaaccctttcccggg

SEQ ID NO: 391545 - DNA, 712 bp, Homo sapiens
  misc_feature: GZ8MTXP01DCNQ4.39.81.H04.1.454.CMB.2.raw
  modified_base (216)..(216): a, c, t, g, unknown or other
  modified_base (272)..(272): a, c, t, g, unknown or other
  modified_base (334)..(334): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctnagtgaaggtctctgcagtcttctgttacacctttacaatatggtatcgaggttggngcgacgacggccctaggacagggtcttaggagtggagtggatggactcgagtcgtacttaanagttcggacaacgaactaaacttagcgacccaaccgaacggtaaccctcggaacggggtaaccaagtaaccgtacccaaaccgtactacggaaaccccaaacgacgtaaacccaactacgtaccccgaacggaacgtacccgaacccgggtacccttaacgagttacgggaacccttgggaacggaacgccgttaaggggacgtacgttacgacgggaaccgtacgaccggtccgttaagttaccgttcggtagtacggaggtaacggtaaggttaacggtaacgggttaaatttacgggtttcgttaccgtttcgttacccgtttgttacggaaccgttcgggtacgggaccgtaaccgggttaaccgtttaaccgg

SEQ ID NO: 391546 - DNA, 643 bp, Homo sapiens
  misc_feature: GZ8MTXP01CLOLZ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttaccaactatggtatcgaggtttgggtgcgacacggcccctggacaagggcttggagtggagtggggatggatcgaggcgtcttacgaagttcggaccaacgaacaaaacttatacgacccaaccgacgaacccgtaccgacggggaacaacggaacgtaccaaccagtacgaccacacgaacacactacccgacgacgccgaccggacctacacgtcgggaccgttggaacggacgaccgtgggagtactcgtacggacgacgaccggtcgttagtacttactagtcgcggaaggaagaggtacgggttaaagtttagtttcgacgttccggttacccgttcgttacgtaaccgtacggtccgggaccgtaaccggggttaacccgttccgg

SEQ ID NO: 391547 - DNA, 655 bp, Homo sapiens
  misc_feature: GZ8MTXP01EIH8X.39.81.H04.1.454.CMB.2.raw
  modified_base (358)..(358): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggaacagggcttggagtggagtggggatgggatcgaagccgtacttaacaagtggtacaacaacaaactntacgaccaacaacgaaccctccgaaagggcaagacgtccaaccatacgaccaacacgacacactaccacgacgcctaaccggaccttaacacgtcggaacccgtagggaacggacgcccggtaggaacgtaacgtcgacggacccgaacgacccggtaccggttagttaattaccgtggtacggaacggtaaggaggtaacggttaggggtaaaatttcgtttacggccttacgggttaacccttagtttaacggacgttacgggttccgggggtaaccgttaacggggtaaccccg

SEQ ID NO: 391548 - DNA, 668 bp, Homo sapiens
  misc_feature: GZ8MTXP01AOWOS.39.81.H04.1.454.CMB.2.raw
  modified_base (368)..(368): a, c, t, g, unknown or other
  modified_base (421)..(421): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctcctgcaaggtcttctggttacctacctttaccaactatggtatcgtaggttgggtgacgacgacggcccccgtggaccgaagggtcttggaggtggagtggggatggatcagcgactttacaatggtacaacaacaaactntcgaccaacgaagaacccgtccgagggaacaggctacaccatacgaacccaanaacgaacccacacgtacccaacggacgaccgaccggacccttaacgacgtaccgggaaccttgggaacgggacgcccgtaggggaacgtacgttaccgacgaacccggacgtaacccgggtccgttagtacttacgtggcgacggaagaggttaacggtaacggggaaatttgtttgaccgtttcgttaccccgttaagttacggaacttacgggtccgggaccgttaaccgggaacccgttaacgg

SEQ ID NO: 391549 - DNA, 657 bp, Homo sapiens
  misc_feature: GZ8MTXP01ATAYD.39.81.H04.1.454.CMB.2.raw
  modified_base (360)..(360): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctgttactacctttaccaactatggtatcgaggttgggtgcgacacggcccctggacgaagggcttggagtggagtgggatggatcgagcgtacttaacgatcggtacaacaacgaaactancgaccacacgaaccctcgaggacagcgtcaacancgaaccacgaacgacaacactccgaacgacgaccgaccggaccctacgaacgtacgggtaacctacgggacggacgtcccgtagggaacgtacgttcgaacggaaaccgtaaccgtaccgggtaccgtttaggttaacgttaacgttggtacgcgggaaaggagggttaacgttacggggttaaatttggttttacgacgttccggttaccctttgttacggtaacgttacgggtcgggaccgtaaccgggttaaccgttcgg

SEQ ID NO: 391550 - DNA, 632 bp, Homo sapiens
  misc_feature: GZ8MTXP01CNLFR.39.81.H04.1.454.CMB.2.raw
  modified_base (275)..(275): a, c, t, g, unknown or other
  modified_base (407)..(407): a, c, t, g, unknown or other
  modified_base (469)..(469): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtcctccagtcctccctcgcccgtcacccgttggacacggcccggcctccatcctcctgcaggtctagtacaaagcctagtatacattgatagaaacactattgaatgttcagnagacggccaggaccaatctacgaaggcctacctttaaatttagtaacggtttaccaacccgggtactccggtagggtacccagacagtacttcgagcggcaggtgggcaaggctacgtgtaactcaactaanagaaactgaagtacgaggggtgacggtgtagggaggtagttggttagggtttattacgtagngtagtaggaacgaaacggtaaccagaccgttacggacccgttaccgtaaccgttacggttttaccggaccgggtaaggggaaccgaggtaccggttaggaaaccgtagttaaccgaaacgttaaccggtgtacggtcctagccttaccgtaacttccggttcc

SEQ ID NO: 391551 - DNA, 710 bp, Homo sapiens
  misc_feature: GZ8MTXP01CWJP6.39.81.H04.1.454.CMB.2.raw
  modified_base (356)..(356): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggacaagggcttgagtggagtgggatggatcgagcgtacttacgaagttggtacaacaacaaaactntacgacccaacaacgaaccctccgaagggaccaagcgtaccaaccatacgaacccaacgaacgaaccacactacccaacggacgaccgaacccgggaccttaaccgacgtacgggaaccctagggaacgggtacgcccgttaggggaacgtacgttccgacggaaccgaaccggtaccgggtcccgttaagttaacgttaccgtaggtcggacggtaagtaacggttacggttaaacgggggttaaattttaggtttacggttaaccgtttccgggttaacccctttcggttttacgaaccgtttacggggtacggggttacccggtaaccggggttaaccccgttaaccgggg

SEQ ID NO: 391552 - DNA, 723 bp, Homo sapiens
  misc_feature: GZ8MTXP01A2QEY.39.81.H04.1.454.CMB.2.raw
  modified_base (229)..(229): a, c, t, g, unknown or other
  modified_base (261)..(261): a, c, t, g, unknown or other
  modified_base (270)..(270): a, c, t, g, unknown or other
  modified_base (354)..(354): a, c, t, g, unknown or other
  modified_base (462)..(462): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctggagatgacgaagccgtgggcctcgagtgaagtctcngcaggtcttctgttactaccttacatatgtancgtggtggngcgacacggccctggacgaagggtcttggaggtggagtagggagtggatcgagctacgttacagtcggtacaacaaacaaactntacgaccaacgaacgaacccgtccgagggaactaagcgtacaaccgactacgaaccaagaacgaaaccactaaccgtaccgaacgacgtacccgaacggtaccctaanacggttacggaccgaggaacggccgtaccgtaagggacgtacttacgaacggaacgtaccggacggtccgttaagttacgttaccggtgtacggacggtaaaggtacggttaaagggtttaaaccggggttaaattttccggtttaaccgggttacgtttcccggggtttaacccctttaacggttttaacggaaccgggttttaacccggggcccgggggttaaacccctaacgggggttaaccccgtttaaccccgggg

SEQ ID NO: 391553 - DNA, 618 bp, Homo sapiens
  misc_feature: GZ8MTXP01B70V0.39.81.H04.1.454.CMB.2.raw
  modified_base (215)..(215): a, c, t, g, unknown or other
  modified_base (352)..(352): a, c, t, g, unknown or other
  modified_base (521)..(521): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttctgttaccacctttaccaatatggtatcgaggttggtgcgacgacggcccctggacgaagggcttggaggtggagtgggatggatcgagcacttacaatggtcaacacaaactntcgaccacacgaaccctccgaggacaagcgtcaaaccatacgaacccacaacgacacactacccgaacgacgaccgaaccggaccctaccgaagtcggaccgtaggaacgggacgaccgtagggacgtaagtccgtaggaccgaaccgacggtccgttagtacttacgngtacgcgaaggaagttagggtacgggttaaattgtttcgacgttcgttacccttgttacgtaacgttcggcgggaccgtaacgggttaacccgtcgg

SEQ ID NO: 391554 - DNA, 707 bp, Homo sapiens
  misc_feature: GZ8MTXP01CV7J4.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaaggtcttctacggttactaccctttaacaacttatggtatcgaggttgggtgcgacgacggccccgtaggacgaagggcgttaggaggtggagtgggagtggatcgagcgacttaacaagttcggacaacaacaaactatcgaccaacaacgtacctcccgaggaacaacggaacgtaccaaccagtaccgaacccaacgacgaaccaacaaccgtaccgaaccggacgacccgaacccgggtacctaacgacggtaccgggacccgtagggaacgggaccgtccgtaggggaacgttaacgtccgtaacgggaccgtaaccggaccggtccggtttagtacgttaccgtggtcgacgggtaaaggtacggttaaggggtaaacgggttaaattttcgtttacggttaccgttcggtttacccttgtttacggcgttaacgggtcggggaaccggtaacgggttaaccccgttcgg

SEQ ID NO: 391555 - DNA, 661 bp, Homo sapiens
  misc_feature: GZ8MTXP01BNL7U.39.81.H04.1.454.CMB.2.raw
  modified_base (363)..(363): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttaccacctttaccaactatggtatcgtaggttgggtgcgacgacggccccctggacaaggggcttggacgttggatggggatggatcgagcgtcttaacgaatcggtacaccacaaactntcgacccacacgaaccctcgagggacagcgtaccaccagtcgaccacagaccacactaccaacgacgacaccggacctacgtacgtacggacccgtagacgggacgcccgtaggggacgtacgtaccgtacggaccgaccgaccggtccggtagttacgttaaccgtggtacgccggaaggaaggttacggtaacgggggttaaatttagtttacggttaaccgtttcgggttacccttcgtttacgtaaccgttaccggtacggggttacccggtaacgggttaaccccgttccggg

SEQ ID NO: 391556 - DNA, 710 bp, Homo sapiens
  misc_feature: GZ8MTXP01C5U43.39.81.H04.1.454.CMB.2.raw
  modified_base (189)..(189): a, c, t, g, unknown or other
  modified_base (274)..(274): a, c, t, g, unknown or other
  modified_base (612)..(612): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctcagtgaaggtctcctgcaaggcttctggttacacctttacaactatggtatcaggttggngcgacacggcccctaggacgaagggcttgagtggagtgggatggatcaggtcacttacaagtttcggaccaacaaactaaaactacgtacgaaccccgtaaaccgaaacgtaaaccccgtcccgaaacgggggaaacccaacgggaacgttacccgaaaccctaaacgtaacggaaacccccaaacgaacgtaaacccaacctaaacgtccccaaacgggacgacccgaaacccgggacccttaaacgacgttacgggaaccctagggaacgggacgaccgttagggaacggtacttacgacggaaccgaccgaccgggtccgttagtacttacgtgngacgaaggaggttaaggttacgggaaatttacgttgaaccgttcggttaacccttgtttagaaccgtacggtcgggaccgtaacgggaacccgttcgg

SEQ ID NO: 391557 - DNA, 826 bp, Homo sapiens
  misc_feature: GZ8MTXP01B5ROC.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttactacctttaccaactatggtatctaggttgggtgcgacgacggcccctaggacgaagggtcttggaggtggagtgggagtggatcgagcgtacttacaagttggtacaacaactaaactatacgacccaaccgaacgaaccctaccgaggggaacaacgtaacgtacccaaaccgtagtaccgaacccaacgaacgaacccacacttacccggaacgaccggaccacccgggtaccctacgaacgtaccgggaaccgttagggacgggtaacggacccgttaggggaacgtaacgttccgacgggaaacccggtaacccgggaaccccgggtccgggtttaacggttaacgtttacccggtagggttacccgggtacgggaaacggggtaagggtttaaacggggtttaaaccggggggttaaaacttttttaagggttttccgggttaaacccgtttttccccgggggttttaaaccccctttttcggggttttacccggtaaacccgggtttaacccgggggtccggggggttaacccccgtaaccccggggggtttaacccccgttttaacccggggg

SEQ ID NO: 391558 - DNA, 698 bp, Homo sapiens
  misc_feature: GZ8MTXP01ATN2K.39.81.H04.1.454.CMB.2.raw
  modified_base (354)..(354): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttacaactatggtatcgaggttgggtgcgacacggcccctggacaagggcttgagtggatgggatggatcgagcgtacttacgaatcggtacacgaacaaactntacgccacgacgaacctccgagggacaacggaagtccaacccatacggaaccacgaacgtacaacacacccgaacggacgacccgacgggtaccctaacgacgttcgggaaccccgttagggaacggaagtccccgtaaggggaacgtacgttcggtaaccgaaccggtaccgaccgggtacccgtttagttaacgtttaaccggtggtacggaacggtaaggtaacggttacgggttaaacggggttaaatttacggtttacggaccgtttccggttacccgttaacgttacggtaaccggtacgggtaccggggttacccgtaaccgggttaacccgtcggg

SEQ ID NO: 391559 - DNA, 661 bp, Homo sapiens
  misc_feature: GZ8MTXP01DK1WQ.39.81.H04.1.454.CMB.2.raw
  modified_base (229)..(229): a, c, t, g, unknown or other
tcagtcgcactagtcacgaccggtgctcgatttagtagtgtagattcgcggggcacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgagccgtgggcctcagtgacgtctccngcagtcttcgtgttactaccttacactatgtatcgtaggttggtgcgacgacggccccgtaggacgagggtcttggaggtggagtgggatgatcgagtcgtacttacgagtcgtaccaacaaacaatacgtccgaccaacgacgtaaccctcgaaacgggacaaggacgtaccaaacctagaaccgaccaacgtaacgaacaactacgtaccgaacgacgaccgtaacgtacctaagacggtacgaccgtaggaacgtcccgtagggacgtaagtaccgtaccgtacgaaccggaccgtacggttaccgttattacgtacggtgtaggaagtaacggttagtaacggttagggttaaactttggttacgttcgttaccgttcttacggtttaacgacggtcgggacgggtaacccgttaacgggttaacccg

SEQ ID NO: 391560 - DNA, 624 bp, Homo sapiens
  misc_feature: GZ8MTXP01CER9A.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctctgcaaggcttctgttacacctttacaactatggtatcgagttgggtgcgacaggccccctggaacaagggcttggagtggagtgggatggatcgagcgacttacaagtcggtacaacgaactaaactagtcgacccacacgaaccctcccgaaggggcaaggaagtccaaacccatcgaaccacagaaccacaactcccaacgacgaccacgggacctaacagtcggaaccgtgaagggacgccgtaggggatacgtcgtacggaaccgacgaccggggtctaggttattacgtggtcgcggaagagaggtacgggttaaattacgtttgacgttcggttaaccctttgtttacgaacgttccggtggggacccgtaacggggttaacccgttcggg

SEQ ID NO: 391561 - DNA, 687 bp, Homo sapiens
  misc_feature: GZ8MTXP01A45KS.39.81.H04.1.454.CMB.2.raw
  modified_base (248)..(248): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccgcctcatcctctgcagtctagtcaaagcctcgtaatacattgatagaaacncttattgtaattggttcagcagagccaggaccaatctacgaaggtcgtaccttaaagtttacgtaaggtttacctaaacccgggctcgtcggggtacccaggactagtaaccgttcgacgtcgggactagggttcggggtacccaagggacctaacgtaagaaactttacaacgtaaactaagaaaacgtccgaaggaacggagggggtacggagggacgttagggaagggttagttaggggtttagggtttaacgtttacgtaggtacggtaggtacggtaacgaaacgggaacctaacgtaccgtccggtacccttaccgtaccgttacgtttaccgggacccgtaacggggaaccttaggtacgttaggaaacgtaacgttaaaccggaaacgaacgttcggcgtccgtacgaccttaccgtaactttcgttaacg

SEQ ID NO: 391562 - DNA, 632 bp, Homo sapiens
  misc_feature: GZ8MTXP01DJGLS.39.81.H04.1.454.CMB.2.raw
  modified_base (352)..(352): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggtacacctttaccaactatggtatcagttgggtgcgacacggcccctggacaagggcttggagtggatggggatggatcgaagcgtacttacaattcggtacacaacaaactntacgacccaacaacggaaccctcgaaggggacaagcgtacaaccatcgaaccacacgaccacactaccgaacgacgacgacccggacctacacgtacggaccctagggaggacgcccgtagggaacgtagtcgacggaccgacgaccggtccgttagtacgttaccgtggacgcggtaagaggttagtacggggttaaattcgttacgttacgttccgttaccgttccttacgtaacgtacggtaccgggttacggtaaccgggttaacccgttaaccgg

SEQ ID NO: 391563 - DNA, 691 bp, Homo sapiens
  misc_feature: GZ8MTXP01B5VGE.39.81.H04.1.454.CMB.2.raw
  modified_base (256)..(256): a, c, t, g, unknown or other
  modified_base (318)..(318): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaggtctctgcaggtcttctgttactaccttacaatntgtatctagttggtgcgacgacggcccctggacgaagggcttggaggtggagtgggagtggntcgagcgcttacgaatcggtacaacaactaaactatcgacccaacacgaacccgtcccggaggggaacacggaacgtccaaacctagtaccgaaccaacgaacgaaccaacacgtaccccgaacggacgtacccgaaccggaccctacgaacgtacgggaccgtaggaacggacgtacccgttaggggaacgtacgtaccgtacgggaaccgaccggaccggggtccgttacgttacgttaacgtggtcggacggaagggtaaggttaacgggtacgggttaaagttttcggtttacgttacgtttccggttacctttcggttacgtaaccgtacgggtccggggacccgtaaccggggttaacccgtccggg

SEQ ID NO: 391564 - DNA, 712 bp, Homo sapiens
  misc_feature: GZ8MTXP01BJL3S.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctacctttaccaatatggtatcgaggttggtgcgacgacggccccgtaggacgaagggtcttaggaggtggagtgggatggatcgagcgtactttaagaattcggtacacaaacgtaaactgtcgacccaacgacgaacccgtcgaaggggaacaacgcggtaccaaacccagtacgaccaactacgaccactacaccacgagccgacggtacctacacgtacggacctgggaacgtaacgccccgttagggggaaactacgttaccgtaacggaaccgaaccgtacccgggggtaccttagggttacttttaaccgggtgggtacggaacgggtaaagggtaacggttaacggggttaaacgggtttaaagtttacggtttacggttaaccggtttccgttacccgtttgttaccgtaaccgtttacggggacgggttacccgtaaccgggttaacccgtccgg

SEQ ID NO: 391565 - DNA, 653 bp, Homo sapiens
  misc_feature: GZ8MTXP01DXDFD.39.81.H04.1.454.CMB.2.raw
  modified_base (215)..(215): a, c, t, g, unknown or other
  modified_base (436)..(436): a, c, t, g, unknown or other
  modified_base (572)..(572): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaagtctcctgacaaggtcttcgtagttactacctttaacaacttagtggttaatcgtaggttgggtgaccgacgacggccccgtaggaacgaagggtcttaggaggtggagtgggatggatcgagcgtacttaacgagttacggtaccaacaactaaactagtcgacccaacgtaacgaacccgtccggaaggaccaagaacgtaccaaacccgtanaccgaaccaacgaacgtacccaacacacccgaacgacgacccgtaacggaccctaagacgtacggacccgaggacggaacgccgtaggacgtacgttcgacggaccgtaccggacgtcgttaagtactagtgacgnggaagtacggaggtaggttaaattcgttagacgttcgttacccttgtactaaccgtggcggaccgtaacggttaaccgtcg

SEQ ID NO: 391566 - DNA, 623 bp, Homo sapiens
  misc_feature: GZ8MTXP01DK479.39.81.H04.1.454.CMB.2.raw
  modified_base (237)..(237): a, c, t, g, unknown or other
  modified_base (268)..(268): a, c, t, g, unknown or other
  modified_base (296)..(296): a, c, t, g, unknown or other
  modified_base (302)..(302): a, c, t, g, unknown or other
  modified_base (347)..(347): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcagcttntgttacacctttacatatggtatcagttggncgacacggccctggacaggcttgagtgngtgggntgatcgagcgtacttaacaagttcggacaaccgtaacaaaacgtntacgacccaactaacgtaaccctccgaaggggacaagtaacggtaccaacccgagtaccgaaccacaagacctacactacccgaagacgacgaccgacctaacgacgtacggacctaggacggacgtcccgtaggaacggtcttccgagaccgacgtacggtccgttaaagttgttacgtggacgcggaagaggttaggtacgggttaaattgtttacgacgttccggttaccttgttagtcgtacggtcgggacccgtcgggttaaccgttccgg

SEQ ID NO: 391567 - DNA, 568 bp, Homo sapiens
  misc_feature: GZ8MTXP01BTZY4.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacactacttgaattggttcagcagaggccaggccaatctacaagcacttaatttataaggtttcaaccggctcgtcggggtcccagacagtattcgagtcggcaaggtgggtcagggcacgtgaattcacactagaaatcagcgagggtggaggcgtaggagggtagttgggttggggtttaagttcgtaggggtatagttgacgaaaggaactacgacgtcggacctccgtaactacgtttggaaccgtagggacccaagcgtaggagttacgttacgaaacgtaactagtcggactcgactaaccgttaagttccg

SEQ ID NO: 391568 - DNA, 631 bp, Homo sapiens
  misc_feature: GZ8MTXP01EZTL5.39.81.H04.1.454.CMB.2.raw
  modified_base (239)..(239): a, c, t, g, unknown or other
  modified_base (330)..(330): a, c, t, g, unknown or other
  modified_base (530)..(530): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttntggttacacctttaccaactatggtatcgtagttgggtgcgacacggcccctggacaagggcttggagtggatgggatggatcagcgctanaatggtacacaacaaactatacgacccaacgacgaaacccgtccgaaggggaacaacggcgtaccaacctagacgaacccaacgaacgaacaacatacccaacgacgaccacggacctaacaagtcggaaccgtggaacggacgcctaggggaacgtaatccgtacggaaccgaaccgacgggccgttaggtacttacgngtgacgaaggagttaaggtaaggggttaaattagtttacgacgttcggttaacccttgttacgaacttagggtccgggacgtaacgggttaacccgtaacg

SEQ ID NO: 391569 - DNA, 740 bp, Homo sapiens
  misc_feature: GZ8MTXP01EW0E9.39.81.H04.1.454.CMB.2.raw
  modified_base (345)..(345): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtgttactacctttacaacttatggtatcgaggttgggtgcgacgacggcccctggaacgaagggtcttaggaggtggagtggggatggatcgagcgtacttaanaagtggtacaacgaaacaaactagtacgacccacaacgaacccgtcgacgggaacagaacgtcaaccgtatacgaaccacgacgaacacactaccaacggacgccgaacggtaccctaacgacgtcgggaaccctaggaacgggaactacccgtagggggaacgtaacgtttacccgaacgggaaacccgtaacccggtaacccgggggttacccttaaggtttaaccgttacgttagggtacgggaaccgggtaaacggtaagggttaaacgggttaaacggggttaaattttacgggtttaacgttacccggtttcgggttaaccccctttggttaggtaacccgttaccggggcgggggttaacccgtaaccgggggttaaccccgttcggg

SEQ ID NO: 391570 - DNA, 747 bp, Homo sapiens
  misc_feature: GZ8MTXP01EVZI2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacttatggtatcgaggttgggtgcgacgacggcccctagggacaagggcttggaggtggagtgggatggatcaggcgtacttacgaagttcggtacaactaacaaaacgttatcgacccaaccgaagtaaacccgtccgaagggaaccaaggcgtaccaacccgtataccggaaccccaacgtaacgaaccaaccactaccccgaaacggacgaccgaaacccgggaccctaaaccgaacggttacgggaaccccgtaggggaaacggtaccggtacccgtaacggggacgtaacgttccggtacggaaaccgggaaccccgaccggggtacccgttaggttaacgttccgtaggtacgggaccggaagggtaacggttaaacgggttaagggggttaaaactttacggttttacgaccgtttacggtttaccccttgttacggtaaccgttaacgggtcggggaccgtaaccggggttaacccgttccggg

SEQ ID NO: 391571 - DNA, 673 bp, Homo sapiens
  misc_feature: GZ8MTXP01CSLFR.39.81.H04.1.454.CMB.2.raw
  modified_base (194)..(194): a, c, t, g, unknown or other
  modified_base (204)..(204): a, c, t, g, unknown or other
  modified_base (209)..(209): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacncgccgcctcntctcngcaggtctagtacaacgcctagtatacattagatagaaacctaccttatgtaattgtacagcagacgcagacatcacgagctacttaatttacgtacggttaccgaacggtcttcggtcgggtaccagactagtatccgacggcgcgtaggtcggaacgtagctaacgtagtaacgttacaacacgttaaagaaaacgtcgaaggtacggtaggggtaggacggtggtaggtaagggttaggtttaggggttttagggttattacggtgtacgtaggttacggaacgtaaacgacaaccgtacgtccggtacccttaaccggttacgtttaccgggttaccgggaccgggtaaaccgggaaccgtaacgggttaccgtaagggaaccgttaaacggaaccgttaaacgttaggttcggtaacgggtctaacggtacccacgttattccggtttcgtttaacccg

SEQ ID NO: 391572 - DNA, 681 bp, Homo sapiens
  misc_feature: GZ8MTXP01AQN7M.39.81.H04.1.454.CMB.2.raw
  modified_base (261)..(261): a, c, t, g, unknown or other
  modified_base (337)..(337): a, c, t, g, unknown or other
  modified_base (355)..(355): a, c, t, g, unknown or other
  modified_base (376)..(376): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgaaggcttctggttacacctttacaactntggtatcgtagttgggtgcgacacggcccctaggacaagggcttgaggtggagtgggatggatcgagcgacttaanagtgtacacacaaacgtntacgcccaacacggtaacccnccggaaggacaagccgtacacccgatcgaaccacacgtaacacacgccacgacgacgtacggacctacagtcggaccgtggaacgcgtccgtaggacgagttccgaagaaccgacggtacccggtcgttaaggttaacttccggtaggtaccggacggtaaaggtacgggttaacgggttaaaggggttaaactttacggtttaccggttaccggtttcccggttacccgttttaaggttaccggttaaccggtaacccgggggttaccggggttaacccgggtaaccgggttaacccgttcggg

SEQ ID NO: 391573 - DNA, 757 bp, Homo sapiens
  misc_feature: GZ8MTXP01B533V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctgttaccacctttacaactatggtatctaggttggtgcgacaggcccctggacgaagggcgttagaggtgggagtgggatggatcgagcgtacttacgaagttcggtacaaacgaactaaaactcgtacgaccctaaccgaaacgtaacccctacccggagggggaaccaaggaacgtaccaaacccgagtaccgaacccaccgaaacgaacccaaccgaactaccccgaaacggaacgacccgaacccggtaccccgttaaacgagttaccgggaacccgttagggaaccgggtacgccccgtaaggggtaacgtaacgttaccgtacgggaaccgtaacccggacccgggtaccgttacggttacttaccgtaggtacggtacggaaaggtaacgggttaacggtacggggttaaatttaacggttttcgttaaccgtttcgggttaacccctttcgttacggttaaccgtacgggttccgggggacccgtaaccggggttaaccccgttccggg

SEQ ID NO: 391574 - DNA, 671 bp, Homo sapiens
  misc_feature: GZ8MTXP01BHKWK.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccgttggacacgccggcctccatctcctgcaggtctagtacaaagcctcgtatacattgataggaaaccaccttacttgtaattggttacagacagacggccaaggccaatcctaccgaaaggcgtaccttaaatttaagtaaacggtttaccgtaacccgggtacttccggtacgggtaccccagaacagtacgttcgaggcggtacgaggttcgggtacgaacggtactaacgtagtaaactttaccgaaactaaacgttaaagaaaacgttccgaaggtacggaagggggtacgggaaggtacggttaggggtaaggttaaggtttggggtttaaggggtttaatttacgtagacggtagttacggaacgaaaggaacctacgtacgtcgtacccgttacgtacgttacgttcggacggaacggacaggtcgttaggactattacgaaagttacgtgtagctacgaccttacgtcgttcgttcg

SEQ ID NO: 391575 - DNA, 755 bp, Homo sapiens
  misc_feature: GZ8MTXP01A7HVP.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctggttactacctttacaacttatggtatcgtaggttgggtgcgacgacggcccctggacgaagggtcttggaggtggagtgggagtggatcgaggcgtacttaacaagtcggtaccaactaacgaaactagtcgacccaacgacgaacctccggaagggaacaggccgtacaccaataccgaaccaacgacgaaccaactaacacccgaaacgacgacccgaacggtaccctaaacgtacggtacgggaacctagggaacggaacgtcccgtaggggaaacgtacttaccgacgggaaaccgtaacccggtccggggttaccgttaaggttaaccgttaacggtcgggtacggaacgggtaaaggtaacgggttaaacggggtttaacgggttaaaagtttcggtttttaacggaccggttttaccggggttaaccccttttggttttaaccgggaacggtttacccggggacgggggttaaccccggtaacggggttaaccccgttaaccggggg

SEQ ID NO: 391576 - DNA, 726 bp, Homo sapiens
  misc_feature: GZ8MTXP01CP18E.39.81.H04.1.454.CMB.2.raw
  modified_base (279)..(279): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttactacctttaccaatatggtatcgagttggtgcgancggccctggacgaggcttgagtggagtgggatggatcgagcgtacttaacgaagttcggtaccacgaaactaaaacgttgtacgaccccaaacgacgaacccgtacccgaggggtaacacgaacgtaccaaaccgtagtacgaacccgaacaaacgacaaccactacccgaacgaccggaccaacccgggacccttaacgacgttacgggaccccgtgggaacggtacggtacccgttaggggaacgttacgttcccgaacgggaacccgaacccggtacgggtcccgttaagttaacgttaccgtagggtcggtaccggaaggtaaacggttaggtaacggggttaaattttacgggtttcgaacccggtttcggttaaccccgtttggttaccgtaacgttccgggtcggggttacccgtaaccgggttaacccggttaacccgg

SEQ ID NO: 391577 - DNA, 660 bp, Homo sapiens
  misc_feature: GZ8MTXP01B41GN.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaatatggtatcagttgggtgcgacacggcccctggacaagggcttggagtggagtgggattggatcgagcgtcttaacgaattcggacaacaacaaactatcgaccaacgacgaaccctccgaaggcaagaacgtaccaccatacgaaccacaagtaccactaacacccacggacgaccaccgggtaccctaacgagttacgggacctgggaacggacgacccgttagggaagtacttccgaacggaccgaacgacccgggtacgttacgttaacttaccgttgacggacggaaggtacgttaggttacggggttaaatttacgtttcggacgtttacgggttacccctttgttacggaaccttcggggtcgggttacccgtaacgggttaaccccgttcggg

SEQ ID NO: 391578 - DNA, 646 bp, Homo sapiens
  misc_feature: GZ8MTXP01DWTRY.39.81.H04.1.454.CMB.2.raw
  modified_base (387)..(387): a, c, t, g, unknown or other
  modified_base (403)..(403): a, c, t, g, unknown or other
  modified_base (412)..(412): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatggacgaagcctggggcctcagtgaaggtctcctgcaggtcttctggttacacctttaccaacttatggtatcgaggttgggtgcgacaggcccctggacaagggcttgaggtggagtgggatggatcgagaccgtcttaacaattggtacaacgaacaaactatcgaccacaagaacctcgagggacagngtccacatcgaccganagacacacnccaacgagaccacggacctacgacgacgggaccgtacgacgggtacgccgttaggggatacgtacgtacggaaccgaccgtacggggtccgttacgttacgttaaccgtggtacggcggtaagaacgggttaaggtacgggggttaaatttagttttaacggacgtttccgggttaccctttcgttaggaaccgttacgggtccggggaccgtaaccgggttaacccgtccggg

SEQ ID NO: 391579 - DNA, 614 bp, Homo sapiens
  misc_feature: GZ8MTXP01BA6L8.39.81.H04.1.454.CMB.2.raw
  modified_base (355)..(355): a, c, t, g, unknown or other
  modified_base (527)..(527): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgtaggttgggtgcgtacaggcccctggacaagggcttgagtggatgggatggatcgagcgtacttacaagtggtacactaacgaaactntcgacctaacgaacgaaccgtccgagggacaagtcgtaccacacgtacgaaccacgacaacactacacgacgacgaccgaacggtacctaagtacgtacggaccgtagggaacgacgtaccgtagggacgtacgttacaggacccgaacgaccggtcgtagtactagtgcgngaagtcgaggtacggttaatttagtagttacgttcggttaccctgttacgaaccgtggtcgggaccggtaacggttaacccgttcgg

SEQ ID NO: 391580 - DNA, 657 bp, Homo sapiens
  misc_feature: GZ8MTXP01BTM0V.39.81.H04.1.454.CMB.2.raw
  modified_base (276)..(276): a, c, t, g, unknown or other
  modified_base (414)..(414): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcagtgaaggtctcctgcaaggtcttctggttacacctttacaactatgtatcgagttggngcgacacggcccctggaacagggtcttggagtggatggggatggatcgagcgtacttacgaagtcggtacaacaacaaactatcgaccacgaacgaaccctccgaaagggacaaggactaccaacccatacgaaccanaacgaccaacacgtaccacggacgacgaaccggcctaacgacgtacggaccgtggaaggacgccggtaagacgtaacttcgacggaacccgaccgtacgggtaccgttagttaacttaccgtggtcggaacggtaaggaggtaacgggttaacggggttaaaatttgtttacgcgtttacggttaaccctttcgtttaacgaccgttacgggttcggggtaacccgttaacgggggtaacccg

SEQ ID NO: 391581 - DNA, 677 bp, Homo sapiens
  misc_feature: GZ8MTXP01BB635.39.81.H04.1.454.CMB.2.raw
  modified_base (500)..(500): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttcgtgttaccacctttaccaactatggtatcgtaggttgggtgcgacgacggcccccgtgggaaccaaggggtcttggaggtggagtggggatgggactcgagcgtacttaacgaagttcggtaccaacgaactaaactcgtagaccccaacgaacgaaccctccgaaggggaaccaggaagtcccaacctagtaccgaacccacgaacgaccaaccactacccgaacgacgaccctaacgggacctacgacgtcggaaccnggaacggacgcccgtaggggacgtacgtccgaggaaccgaccgaccggtccgttagttaacttcggtgtacggcggtaagacggttagggtaacgggttaattggtttaacgccgttcggttaccccttgttccgaacgtaccgggtcggggaccgtaacgggttaacccgttcggg

SEQ ID NO: 391582 - DNA, 681 bp, Homo sapiens
  misc_feature: GZ8MTXP01BWMJZ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtgttactacctttaccaactatggtatcgaggttgggtgcgacgacggccccgtggacaagggtcttggagtggagtgggatggatcgagcgtacttaacaagttcggtacaacgaacaaaactatcgacccaacacgaacctccgagggaacagcgtacaaccatacgaaccacacgacacactaccgacgagaccgacggaccctaagagtcggaaccgtgaacggacgccgttaggggaacgtacgtaccgtacggaacccgtaaccggaccgggtaccgttagttacttaccgtgggtacgacgggtaaggtaggttaacgggttaaacggggttaaatttacggtttacgaccggtttcggttaccccctttaagttacggtaaccgttacgggtccgggggttaacccgtaaccggggttaaccccgttccggg

SEQ ID NO: 391583 - DNA, 687 bp, Homo sapiens
  misc_feature: GZ8MTXP01ANEIL.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtctggagctgagatgacgaagccgtggggcctcgagtgaaggtctccgtgcgaaggtcttcgtggttaacctaaccctttaaccaacttatcgggttatcgtaggtttgggtgacgacgacgggccccctaggacgaagggtcttggaggtggagtgggatggatcgagcgtacttaacaagttggtacaacaacaaaactatcgaccccaacaacgaacccgtccgaacggggaacaagaacgtaccaaccgaagtcgaaccaacaacgtaaccacgaactacccgaacggacgaccgaccggaccctaacgtacgacggacccgtagaacgggtacgcccgtagggacgttacgtccggacgaaaccgtaccgaacgggtcccgttagtaacgttacgtggtacgaggtaagtaggttaggtacggggttaaatttgtttcgacgttcgttacccgttgttacgaacgttacgcggggttaccctaacggggttccctccgg

SEQ ID NO: 391584 - DNA, 675 bp, Homo sapiens
  misc_feature: GZ8MTXP01BUYZV.39.81.H04.1.454.CMB.2.raw
  modified_base (240)..(240): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttntgttacacctttacaatatggtatcaggttggtgcgacgacggcccctagggacgaagggcttggaggtggagtggggatggatcgaggacgtacttacgaagttcggtacacgaactaaactatcggacccaacgaacgaaccctaccggaagggtaccaaggaacgtaccaaaccgacgtaccggaacccacgaaacgaaccaaccaacgtaccccgaaacggacgacccgtaaccgggtaccctaacgacgtacgggacctacgggaacggacgccgtaggacgtgttacgacggacgaccgacggtccgtagttactacgtgtacgcgaaggagttaaggtacggttaaatttacgttcgacgttcggttaccctttaagttcggtaaccgtcgggtacgggacggtaacccgggttaaccgttaaccggg

SEQ ID NO: 391585 - DNA, 659 bp, Homo sapiens
  misc_feature: GZ8MTXP01CZBE0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgactaaggtctttcgtaggttaacctacccttttaaccaacttatggttatcgaggttgggtgcgacgacggcccctggacgaaggcttgaggtggagtgggatggatcagcgtacttaacgaagtcggactaacgaacaaaacttatacgacccaacgaacgaaccctaccgaggaaccaacgcgtaccaaaccgatacgaaccaacgaacgaccaacacgtacccaacgacgaccaccggacctacgacgtacgggaaccgaggaacgacgccgtagggacgtagtaccgtacgacgaccgaccggtacgtacgttatacgtagcgacggtaagaaggttagtaacgggaatttagttacgttacgttcgttacccttgttacgtaacgtcggtacgggaccgtaaccgggttaaccgttaaccgg

SEQ ID NO: 391586 - DNA, 694 bp, Homo sapiens
  misc_feature: GZ8MTXP01CITDO.39.81.H04.1.454.CMB.2.raw
  modified_base (371)..(371): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgacaggtcttctagttaccacctttaacaactatggtatcgtaggttggtgacgacgacggccccgtaggaccgaaggtcttaggaggtggagtgggatggatcgagcgtacttacaagttcggacaacaactaaaacgtntacgacccaacgaacgacccgacggaacggaacaacgaacgtaccaaccgtacgaccgaaccaacgaacacctacacgtaccgaacgacgaccgtaccgaactacgacgcgacgtggaacggcgaccgtagggaacgtacgtacgacggaaccgacccgtacggtacgtttaagtacgttacggtgacggaaggtaaggtaaggttacgggttaaacggttaaattttacggtttccgttacgtttacccggttaccgtttaacgttacggtaaccggttacgggtacccgggttacccggtaacccgggttcccgttccggg

SEQ ID NO: 391587 - DNA, 710 bp, Homo sapiens
  misc_feature: GZ8MTXP01A46IP.39.81.H04.1.454.CMB.2.raw
  modified_base (284)..(284): a, c, t, g, unknown or other
  modified_base (336)..(336): a, c, t, g, unknown or other
  modified_base (356)..(356): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggtcttctggttactacctttacaactatggtatcaggttgggtgcgtacncgggccccctggacaagggcttggagtggatggggatggatcagcgacttanaagtggtcaacacaaaactntcgaccacacgaaccctcgagggacagcgtcaccatcgacactaagactacataccgaacgacgccgtaccggacctaacgacgttacggggaccctgggaacgggacgtacccggtagggaacgtaacgttccggacgaaacccggaccgtaacccgggtacccggttaagttaacgttaacgtcgggtaccggacgggaaggtaaacggttaagggtaaaccgggggttaaaattttacggtttacggttaaacccgtttccgggttaacccctttaacgttacggtaacccgtttaaacgggggtccgggggttaaccccgtaaaccgggggttaaccccgttaaccgggg

SEQ ID NO: 391588 - DNA, 729 bp, Homo sapiens
  misc_feature: GZ8MTXP01CIB7E.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaagtcttctgtactaccttacaactatggtatcgtagttgggtncgacgacggcccctaggaacgaagggcttaggaggtggagtgggatggactgagcgtactttaacaagttcggtacaaacgaaactaaactatacgacccctaacaacggtaacccgtccgaaggggtaacaacggtcgtacccaaaccgactacggaaccaacgaacgaactaacacgtacccgaacggacgaccaccgggtacctaacgagtacgggaaccctggaacggcgtacccgtaggggacgtaacgttccgaacggaaccgacccggtaaccggttcgttacggttaaacttacggtcggtacgggaacggaaagttaacgggttaagggttaaaccgggggttaaattttacggtttacgttaccgttccggtttaacccgtttaacggtcggttaaccgtacgggggttcggggaacccgtaacccgggttaacccgttccggg

SEQ ID NO: 391589 - DNA, 614 bp, Homo sapiens
  misc_feature: GZ8MTXP01A2DGY.39.81.H04.1.454.CMB.2.raw
  modified_base (351)..(351): a, c, t, g, unknown or other
  modified_base (379)..(379): a, c, t, g, unknown or other
  modified_base (395)..(395): a, c, t, g, unknown or other
  modified_base (404)..(404): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacaggcccctggacaagggcttggagtggatgggatggatcgagcgacttacgaattggtacacaacaaaactntgacccacagaaccctccgagggacagngtccaccatcgaccanagacactanccaagacgcgacggtacctaacagtcggaaccgtggacggacgcgaggggaacgtacgtcgtacggaaccgaccgtaccgggtcgttagtacttacgtggacggaggaaggaaggttaacgggtaacgggttaaatttcgtttacgaccgttccggttaccttgttacgaaccgttacgggcgggttacccgtaacgggttaacccgtcg

SEQ ID NO: 391590 - DNA, 719 bp, Homo sapiens
  misc_feature: GZ8MTXP01A9GH4.39.81.H04.1.454.CMB.2.raw
  modified_base (373)..(373): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaaggtctccgtgacaggtcttcgtggttacctacctttaccaactagtggtatcgtaggttggtgcgacgacggccctaggaccgaagggtcttggaggtggagtgggatggatcgagtcgtacttaacgaagtcggtacaaactaactaaactntacgaccaacgacgaacccgtacgagggaaccaaggaacgtaccaaacgagacgaacccagaacgaccacaactacccggaagaccgtaccgaacggtacctaaacgagtccggaaccgttagggaacggtacgtccgttaggggaacggtactaccgtacggaaccgtaaccggacccggttagttaaccgtttaagtttccggtagtcgggaaccgaagggttaacgttaggggttaaaccgggttaaagttttacgttaacgttcccggttttcggttaccctttaacggttttaccggaacgttacccgggacgggccccggtaaacggttcccgttcccgg

SEQ ID NO: 391591 - DNA, 775 bp, Homo sapiens
  misc_feature: GZ8MTXP01EATSU.39.81.H04.1.454.CMB.2.raw
  modified_base (338)..(338): a, c, t, g, unknown or other
  modified_base (363)..(363): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggctcagtgaaggtctctgcaggtcttctgttactaccttaccaactatggtatcgtagttgggtgcgacacggccccgtaggacgaagggtcttggaggtggagtgggagtggatcgagcgtacttanaagttggtacaacgaactaaaactntacgacccaacgaacgaaccctccgaagggaccaagcgtaccaaccagtaccgaacccaacgacgaaccactaactaccccgaaggaccgaccgaacccgggtaccccttaacgaacgtccggaaccgtaggaacgggtaccgcccgttaggggaaacgtcgttacccgaagggaaccccggaacggtacccggggttacccggtttaagtttaacgttaccggttaggtacggaaccgggtaaaggtagggttaacgggttaaaccgggggttttaaaaatttggtttttaaccgggttaccgttttcccgggtttaaccccccgttttggtttttaaacggccccggtttaacggggttccggggggttaaccccgttaacccgggggttaaaccccgttttccccgggg

SEQ ID NO: 391592 - DNA, 689 bp, Homo sapiens
  misc_feature: GZ8MTXP01DGAMQ.39.81.H04.1.454.CMB.2.raw
  modified_base (364)..(364): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaaggtcttctgttacacctttacaactatggtatcgtaggttgggtgacgacgcggccccgtggaacgaaggtcgttggaggtggagtgggatggatcgagcgtactaacaagttcggacaacaactaaactntacgaccaacgaacgaccctcgacggacaagtcgtaccaacgacacgaaaccacgaaagaccacactaccgaacgactaccgaaccggaccttaacgacgttacggacccgttaggacggacgtcccgtaggggtaacgacgttaccgtacgaacccggtaccgtacccggtcggtttaagttacttacggtgacgtacggaaggtaggttaacggttaacgggttaaagttttcggttacgttaaccggtttccgtttacccgtttgttaacgggtccgtttacgggccggggttaccccgtaaggggttaaccccgttccggg

SEQ ID NO: 391593 - DNA, 620 bp, Homo sapiens
  misc_feature: GZ8MTXP01C1M3Y.39.81.H04.1.454.CMB.2.raw
  modified_base (407)..(407): a, c, t, g, unknown or other
  modified_base (523)..(523): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttacacctttacaactatggtatcaggttgggtgcgacgacggcccctggacgaagggcttggaggtggatgggatggatcgaggcgtacttacgaagttcggtacaacaactaaactatcgaccaacacgaaccctaccgaggacagcgtaccaacatacgaccaanacgaccacactaccgaacgacgccgaaccggacctacgagtacgggacctaggacggacgtccgtagggaagacgttcgacggaaccgtaccgacggtccgttagttacgttacgngtacggcgaaggaggaggtacggggttaaattagtttcgacgttcggttaccttgttacgaacgtacggtcggggacctaacggggttcccgttcgg

SEQ ID NO: 391594 - DNA, 661 bp, Homo sapiens
  misc_feature: GZ8MTXP01BS9AP.39.81.H04.1.454.CMB.2.raw
  modified_base (266)..(266): a, c, t, g, unknown or other
  modified_base (277)..(277): a, c, t, g, unknown or other
  modified_base (430)..(430): a, c, t, g, unknown or other
  modified_base (544)..(544): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtgggcctcgagtgaaggtctctgcaaggcttcgtagttactacctttaccaatatggtancgtaggttggngccgacgacggccctggaacaagggtcttaggagtggagtgggatggatcgagcgtacttaacgaagttggtacaaacaaactaaaactagtcgaacccaaacaacggtaaaccctccgaaggggtaacaacgggtcgtaaccaaaccgtaancgaacccaagaacgaaccacactaccgacgacgaccgaacgacctaacgacgtacggaaccgtagaacggagcccgtagggacgtactcgacgaccgacgacggtcgtacgttnttaccgtgtacgaggaagtaaggaggttaacggggttaaatttaggttaacgttaccgttcgttaccgttgttagtaaccgtacggtcgggaccgtaaccggttaacccgttaacgg

SEQ ID NO: 391595 - DNA, 852 bp, Homo sapiens
  misc_feature: GZ8MTXP01E3LJR.39.81.H04.1.454.CMB.2.raw
  modified_base (212)..(212): a, c, t, g, unknown or other
  modified_base (279)..(279): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctnagtgaaggtctcctgcaaggcttctggttacacctttacaactatggtatcaggttgggtgcgtacncggcccctggacaagggcttgagtggatggggatggatcgagcgtacttacaagttggtaccaacaactaaaacttagtacgacccaacgaacgtaaaccccgtacccgaagggggaacctaacgggtaaccggtacccgaaacctaaacgtacccgggaaacccgaaacccaaacgggaaacccttaaccaacctaaccccggaaacgggaacccgacccggtaaacccgggttaaccctaaacgaaacgggtttaccggggaaaccccgtagggtaaaccgggggaacctttccccggtaaagggggaaacggtccgtttaccgaacccggggtaaacccggtaaacccggaccccggggttaccgtttaacggtttaacccgttaaaccggttggggtaaccggtaacccgggaaaggtaaacgggttaagggtaaacccgggggttaaaattttacggtttaacggttaaccccggtttcgggtttaccccctttcgtttacggtaacccggtttacggaccggggggttacccgtaaaccccgggggttaacccgtttaaccccgggg

SEQ ID NO: 391596 - DNA, 682 bp, Homo sapiens
  misc_feature: GZ8MTXP01EYTZU.39.81.H04.1.454.CMB.2.raw
  modified_base (310)..(310): a, c, t, g, unknown or other
  modified_base (329)..(329): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcgtaggttgggtgcgacgacggcccctggacaagggtcttggngtggagtgggatggagtcngctcttaacaagttggtacaaccgaaacaaactagtacgacccaacgaacgaaacccgtccgaggggaacaagaacgtccaacgatcgaaccaacacgaccacaacgtacccaacgacgaccgaccggacccacgacgttacggaccgttagggaacgggacgcccgtaggggacgtaacgttccgtacgaaccggaacccgtaacccgggtcccggttagttaacgttacggttggacggtcggaaaggtaggttaaacgggtacgggggttaaatttaacggttttcgaacgtttcggttaccctttgtcgtaacgtacgggtcggaccgtaaccgggttaacccgttcgg

SEQ ID NO: 391597 - DNA, 655 bp, Homo sapiens
  misc_feature: GZ8MTXP01A5ETI.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctgcccgtcacccttggacagccgcctcatctcctgcaggtctagtcaaacgtcctgtatactattagatacgaaactcctattagaattggttacagcaggacggccagacctaatccgtaccgaaggtcgtaccttaaagtttaacgtaacggtttccgaaaccgggtctaccggtacgggggtacccaagtaccgagtacttacgaggtccggacgtaagggttcgggtcacgggacctaacgttagtaacttcaaactaacgtaagaaaactcgaaggacggtaggggaggaggcgtaggagggtagttggtttagggtttattacgaggtacgagtacgaacgaaaggacctacgaccgtacggtcccgttaccgtacgttacggttcggaaccggaacggggactaaaggttcgaaggaacgttaacgacgaaacgtaagtcggtaaggctacgacctaacgttaacttcg

SEQ ID NO: 391598 - DNA, 732 bp, Homo sapiens
  misc_feature: GZ8MTXP01BE2R7.39.81.H04.1.454.CMB.2.raw
  modified_base (280)..(280): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacacctttaccaactatggtatcgtagttgggtncgacaggcccctggacgaagggcttggagtggagtgggatggatcgagcgtctttaacgaattggtaccaacaactaaaactatacgaccctaacaacgaaacccgtccgaaggggacccaagaacgtaccaaacccgtaagtaccggaaccccaacgaacgaaacccaacctaacgtaccccgaaacgggacgaacccgaaccgggtacccctaacgaagttccgggaaccctagggacggacgtacccgtaggagtactaccgtacggaccgaacggtcggtaccgttagtaacttacgtggtacgacggtaagtaaggttaggttaacggggttaaatttacggttttacggaaccgtttcgggttaacccctttcggtttaacgtaacccggtttaacggggtaccgggggttaaccccgttaacgggggttaacccccgtttccggg

SEQ ID NO: 391599 - DNA, 675 bp, Homo sapiens
  misc_feature: GZ8MTXP01AD51U.39.81.H04.1.454.CMB.2.raw
  modified_base (261)..(261): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaactntggtatcgtaggttgggtgcgacacggcccctggacgagggcttgagtggagtgggatggatcgagcgtactttacaagttcggtacacgaaactaaactatcggacccaacacggaaaccctcccggaagggacctaaggaacgtaccaaacccgatacgaacccacgaacgaaccaaccactacccgaacggacgaccgaacccgggtacctaacgacgttcgggaacccgttaggaacgggacgtacccgtaggggaacgtacttcgaacggaccgaacgtaccgggaccgttagtacttacgtgtcggcggtaagaaggaggttacggggttaaattacgtttacgacgttcggttacccttggttacgaaccgttacgggtcgggaccgtaacgggttaacccgtccgg

SEQ ID NO: 391600 - DNA, 643 bp, Homo sapiens
  misc_feature: GZ8MTXP01BN9K4.39.81.H04.1.454.CMB.2.raw
  modified_base (263)..(263): a, c, t, g, unknown or other
  modified_base (363)..(363): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgcaaggtcttcgtgttactaccctttacaactntggtatcgtaggttgggtgcgacacggcccctaggacgaagggtctaggagtggagtgggagtggatcgagtcgactttacagttggacacaacaaactntcgaccaacacgaacctcgagggaacagcgaccaacagtacgaccacaacgacacacaccgacgacgaccgaaccggacctaacgacgtcggaacgacggacggacgccgtagggaacgtcgtactacggaccgacgccggtacgtacgttatacgtggtagcggtaagacggttaaggtaacgggttaagtttacgttagttaccggttcggtttacccttcgttcgtaaccggttaccgggcggggttaccgtaaccggggttaacccgttaaccggg

SEQ ID NO: 391601 - DNA, 699 bp, Homo sapiens
  misc_feature: GZ8MTXP01BGH4B.39.81.H04.1.454.CMB.2.raw
  modified_base (360)..(360): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaagtcttcgtgttacacctttacaactatggtatcgaggttgggtgcgacacggcccctggacgaagggcttggagtggagtgggatggatcgagcgtcttaacgaagtcggtacaacaacgtaaactntcgaccacacgaaccctcggaagggccaagaacgtccaacctacgcgacccaacgaacgaccactaacgacccaacggacgccgaaccgggaccctaacgacgtacgggaccttacggaaggtacgcccgttaggggaacgtacgtaccgtacgggaacccgaaccgtacccgggtaccggtttaaggttaaccgttagtcggtaggaccgggtaaaggacggttaagggttaacgggggttaaatttaggttttacggaccgtttcggttaaccctttcgtttcgtaaccgttaacggggtcggggttacccgtaacggggttaaccccgttcccggg

SEQ ID NO: 391602 - DNA, 636 bp, Homo sapiens
  misc_feature: GZ8MTXP01ETQO2.39.81.H04.1.454.CMB.2.raw
  modified_base (215)..(215): a, c, t, g, unknown or other
  modified_base (235)..(235): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgagtctctgcagtcttntgtacaccttacatatgtatcgaggttggtgcgacgacggcccctggaacgagggtctggagtggagtggggatggatcgagtcgtactttaacgaagttcggtacaacgaactaaactgtaccgacaacgaacgtaaccctccgaacgggactaagacgtaccacccagtaccgaaccacgaacgaccaacacaccgaacgacgaccgtaaccggacctaacgtacgtacggaccgtaggaacggacgtacggtagacgtactcgtacggaaccgtaccgacggtccgtagttagttacgtggtggaacgtaagaggtaggttacgggtaaatttgtttacgttacgttaccgttccttgttcgtacgtcggttcgggtaaccgttaaccgggtaacccg

SEQ ID NO: 391603 - DNA, 653 bp, Homo sapiens
  misc_feature: GZ8MTXP01AB5A0.39.81.H04.1.454.CMB.2.raw
  modified_base (371)..(371): a, c, t, g, unknown or other
  modified_base (474)..(474): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggtcttctggttacacccgttttaaccaaacttatggtatcgaggttgggtgcgacacggcccctggactaaggcttgaggtggagtcgggatggatcgagcgtacttaacgaagttcggtacaaactaacaaactntacgacccaactacgaacccgtcgaggggaaccaggaactcaacctagacaccagactacacacacccgagacgcgtacgacctagagtacgacgtgaggacncgaggacgtacgtcgacgaccgacgaccggtcgttagtacgttcggcgtaggacgtaaggtaggttaacgggttaacggttaaactttaggtttaccggaccgtttccggtttaacccgttcgttacggtaacggttaccggggtaccggggaaccggtaaccgggttaacccgtcggg

SEQ ID NO: 391604 - DNA, 708 bp, Homo sapiens
  misc_feature: GZ8MTXP01BHM0R.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactaaccctttacaacttatggtatcgtaggttgggtgcgacgacggccccgtggacgaagggtcttaggaggtggagtgggatggatcgagcgtacttacaagttggtaccaactaacaaaactgtagcccaaccaagaaccctaccggaagggaaccaagggaacgtaccaaacccgataccggaaacccaacgaagtaacccaacaacgtaccccgaaacggaccgacccgaaccgggtaccctaacgtaacgtacgggaaccgaggaacgggacgtccgtaggggaacgtacgttccgacggaacccgaccgacgggtcccgttagttacgttacgtggtcggagaacgggtagttaacggttacggggaaatttacgttttacgaccgtttcgggttacccctttgttacgtaaccgttacgggtccggggttacccgtaacgggttaacccgttccgg

SEQ ID NO: 391605 - DNA, 742 bp, Homo sapiens
  misc_feature: GZ8MTXP01BNW5L.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacggaagccgtggggcctacgaggtaggaacggtcctccgtgacgtaaggtccttcgtcggtttaacctaccctttaaccaactagttggttactcgtaggtttgggtcgccgacgacggcccctagggacgaagggtctagaggtggagtggggatggactcgaggtacgtacttaacgagttcggtacaaacctaaacgtaaactacgtcgaaccccaaacgacgaaacccgtcggaacggaacaacgggtaacgtaccaacccgtaagtaccgaaacccacacgtaacccaactacgaacccgaacgggacaccgaaccggtacccagtaacgtcggaacccgttgacgggtacgaccgtagggaacgtcgtaccgacgtaccggaccgccgggtacttattagtccgtgacgacgggaagtacggttaaggttaacgggttaatttacggtttacgttacggtttacccgttaccgtttaacgttcggtaaccgttccgggtaccggggttacccgtaacgggttaaccccgttaacggg

SEQ ID NO: 391606 - DNA, 581 bp, Homo sapiens
  misc_feature: GZ8MTXP01BRPDA.39.81.H04.1.454.CMB.2.raw
  modified_base (373)..(373): a, c, t, g, unknown or other
  modified_base (494)..(494): a, c, t, g, unknown or other
  modified_base (538)..(538): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaagcttctgtacacctttacaatatggtatcgtagttggtgcgacacggcccctggacaagggctgagtggagtgggatggatcagcgtacttacaagtggtacacaacaaactagtcgacacacgaacctccgagggaacagngtcaacatacgaccacagacacagaccacgacgcacggacctaacacgtacggaccgtggaaggacggtctaggggacgtatcgtacgaacgaccgacgtaccgtggtattacgtgtacgngaagtagacggtagggttaattagttcgacgttcggttaccctntttacgaacgttaggtcgggaccctaacgggttaacccgtcgg

SEQ ID NO: 391607 - DNA, 653 bp, Homo sapiens
  misc_feature: GZ8MTXP01EEFKI.39.81.H04.1.454.CMB.2.raw
  modified_base (272)..(272): a, c, t, g, unknown or other
  modified_base (558)..(558): a, c, t, g, unknown or other
  modified_base (625)..(625): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttacacctttacaactatgtatcagttggncgacacggccctggacgaagggcttgaggtggatgggatggatcgagcgtacttacgaagtggtacacgaacctaaactgtacgacccaacgaacgaaacccctccgaaggggaccaaggtaacgtaccaaaccgtaataccgaacccaacgaacgaaccaacaactacccgaaccggaagcccaaaccgggaccctaacgagttacgggacccgttagggaaggaacgtcccgtagggacgtacgtcgaacgacgacgaccggtccgttagttacttagtgtagnggaagagttacggtacgggttaaattagtttcgacgttcggttacccttgttagtaaccgttacggnggggaccctaacgggttaaccgtccggg

SEQ ID NO: 391608 - DNA, 627 bp, Homo sapiens
  misc_feature: GZ8MTXP01A9WTC.39.81.H04.1.454.CMB.2.raw
  modified_base (283)..(283): a, c, t, g, unknown or other
  modified_base (314)..(314): a, c, t, g, unknown or other
  modified_base (325)..(325): a, c, t, g, unknown or other
  modified_base (407)..(407): a, c, t, g, unknown or other
  modified_base (495)..(495): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcgtgcaaggtcttcgtggttacctacctttaacaactagtgtatcgtaggttgggtncgacgcgcccgtggacgaggtcttgagtggngtgggatggancgaggtcgtcttaacgaagtcggtaccaacaactaaactactagacccaacgacgaaccgtcgacggacagtcgacacctanacgacacgacgacacgacaccgacgacaccgacggtacctacgactacgggaccctaggacgggactcccgagggaaagtcgttacgngaacccgtacgaccggtccgttagtaaacttgtacgtggacgaaggaggttacggttaagggttaattggttagttacgttccggttcctgttcgtaacgtggaccgggttacgaacgggttcccgtaacgg

SEQ ID NO: 391609 - DNA, 738 bp, Homo sapiens
  misc_feature: GZ8MTXP01AQBP5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgacaaggtcttcgtggttaacctaccctttaaccaacttatcggtatcgtaggttgggtgcggacgacgggcccctggaacgaagggtcttggaggtggtacgtggggatggactcgagtcggtacttaacgaagttcggtacaactaaacaaactagtacgacccaacgaacgtaacccgacgacggggcaaacgggtaacaccaaccaatacggaacccaacaaacgacctaaccacaaccccgaggaaccgtaccgaaccgggtaccctaaacgacggttacgggaacccgttagggaacggacgacccgttaggggaacgtacgtacgacggaaacccgaccggaaccggtccggttagttaaccgtacgtcggacggagaaaggtaggttaaacgggtaggggttaaatttacggtttaacgttacggttccgtttacccgttcggtttacgtaaccgtcggggtaccgggggttacccgtaaacggggttccccgtccggg

SEQ ID NO: 391610 - DNA, 705 bp, Homo sapiens
  misc_feature: GZ8MTXP01BOQEI.39.81.H04.1.454.CMB.2.raw
  modified_base (583)..(583): a, c, t, g, unknown or other
  modified_base (590)..(590): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttactacctttaacaacttatggtatcgaggttggtgcgacgacggcccctggacaagggcttggaggtggagtgggatggatcgaggcgtacttaacaagttcggtacaactaaactaaaactagtacgacccaaccgaacgaaacccgtccgaagggggacccaaagggcgtacccaaaccgagtacgaacccaacgaacgaaccacctaactacccgacgaacgtcccgaaccgggtaccctaacgtagtaccgggaacccgtagggaacgggacgacccgttagggacgtacgttacgaccggaacgtaccgaacgggtccgttagttacgttcgnggttcgnggtaaacggtggttaaagggttaacgggttaaatttaggtttacggttacgttccgggttacctttcgttagtaacgtaccggtcggggttaccgtaacgggttaacccgtccgg

SEQ ID NO: 391611 - DNA, 756 bp, Homo sapiens
  misc_feature: GZ8MTXP01C6VOQ.39.81.H04.1.454.CMB.2.raw
  modified_base (432)..(432): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccactcccaggttcagctggtacagtctggagctgagatgacgaagccgtggggcctcagtgaaggtctctgcaaggcttctgttacaccttaccaactatggtatcgaggttgggtgacgacgacggcccctggaacaagggcttaggagtggagtgggtaatggatcgaggctacgttaacaaagttcggtaccaacaacaaaactgtacgacccaacaacgaacccgtccgaagggactaagcgtaccaaccctaagtaccggaaccacgaanaccaacacaccgaacgacgtaccgaccgggacctaacacgttacgggaacccgttagaacggacgacccgttaggggaacgtacgttccgaacggaaccggtacccgacgggtaccgggttagttaacctttaacggttcggtagtaaccgggaacggtaacggttaaagggtttaaaccgggggaaaagtttttaaagggttttcccggttaaccgtttaccggggttaacccccttttaagggttttaaacggtaaccccggtttaaacgggtccggggggttaaccccgtaaccgggggttaaaacccccgtttcccgggg

SEQ ID NO: 391612 - DNA, 728 bp, Homo sapiens
  misc_feature: GZ8MTXP01BGL3R.39.81.H04.1.454.CMB.2.raw
  modified_base (260)..(260): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctgttactacctttacaatntggtatcgaggttgggtgacgacgacggccccgtaggacgaagggtcttggaggtggagtgggatggatcgagtcgtacttaacaagttcggtacaacaaactaaactagtcgaaccccaacgaaacggtaaccccgtcccggaaggggaaccaaggaacgttaccaaacccgtagaccgaaacccaacgaacgaacctaacactacccgaaacggacgaccgttaacccggaccctaaacgtacgtacgggaacccgagggaacgggaacgtcccgtaaggggaacgtacgttaccgaggaacccggtaccgaccgggtaccgttagttacgttaaccgtggtacgaacggtaaggtaaggttacggttaacggggttaaatttacggtttcgaacgtttccgggttaacccctttgttacgaacgttacggggcgggttaccgtaaccggggttaacccgtccggg

SEQ ID NO: 391613 - DNA, 777 bp, Homo sapiens
  misc_feature: GZ8MTXP01BPYXG.39.81.H04.1.454.CMB.2.raw
  modified_base (252)..(252): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctccatctcctgcaggtctagtcaaagcctagtatacattgatggaaacnctattgaattggttcagcagacggccaggccaaatcctaccaaggtcgaccttaaagttttacgtaacggtttccaaaccggggtactcgtacgggggtaccccaagacaaggtacttcgaggccggctaaagggttcgggtcaagggtcctaaacgttggtaaactttccgaaactaaccgttaaaggaaaaaacttccgaaagggaccggtaaagggggttagggggtaaacgggtaccggttaaggggtaacggggttaaggtttacggggttttaagggggttttaatttaaccgggttggggtaccgttaaggttacgggaacgtaaaacggggaaacctaacggtaccgttaccgggtaccccgtttacccggttaaaccgttaccgggttttaccggggaacccgggttaaacgggggaaccctaaacgggttccgtaagggtaacgttaaacgttaaccgaaaacggtaaccgttagggtaacggtaccgtacggacctaaccgttaacggtttccg

SEQ ID NO: 391614 - DNA, 628 bp, Homo sapiens
  misc_feature: GZ8MTXP01EO6A5.39.81.H04.1.454.CMB.2.raw
  modified_base (400)..(400): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctgttaccaccttacaactatggtatcgagttggtgcgacacggcccctaggacaagggcttggagtggagtgggatggatcgagcgtactttacaagttggtaccacgaacaaactatcgaccacacgaacctcgaggacagcgtacacgactcgaaccanacgacacactaccgacgacgaccacggtacctaacgacgtcggaaccgttaggaacggacgtccgtaggggactacgttacgacgaccgaaccgtacggtaccgttagttacgttctaggcgacggaaggtagttacggtaagggttaaatttacgtttaacgcgttcggttaccccttgttacgaaccgttacgggtcggggacccgtaacgggttcccgttaacgg

SEQ ID NO: 391615 - DNA, 655 bp, Homo sapiens
  misc_feature: GZ8MTXP01E0QZA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttacaccttacaactatggtatcagtgggtgcgacacggcccctggacgaaggtcttgaggtggagtgggatggatcgagcgtactttaacgaagttcggtacaaacaactaaaactatcgacccaacgaacgaaacccgtccgaggggtaacaaggaacgtaccaaccgaatacgaacccaacaacgaaccaacaactacccgaacgaacgaccaaccgggaccctaacacgtacgggaacctggaacggaacgccgtagggacgtattccgacgaaccgaccgaaccggtcgttagtacgttacgtggtcgcgtaaggaagttaaggtaacgggttaaattagtttacgacgttcggttaccccttgttacgaacgtacgggtcggggacctaacggggttaaccctcggg

SEQ ID NO: 391616 - DNA, 639 bp, Homo sapiens
  misc_feature: GZ8MTXP01E28ZT.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctccatctctgcaggtctagtcaaagcctgtatactattgataggaaactacctattagaatttggttcagcaggacgccaggccaatctaccgaaggctaccttaaatttagtaacggtttccaaccgggcttcggtcgggtacccaagactacggtattcgaggcggacgtaagggtcggggtcacgggctaacgttagaaacttcaaactaaacgtaagaaaactcgaaggacggtaggggtagggacgggtgtaggtagggtagttgggttagggtttaagttacgtaggacgtagtagaacgaaacggaaccacgtacgtcggtaccgttaccgtacgtacgtttcgggaaccggaacgggacgaacggttacgaggaacgaacgttaacgaaacgtaacgtcggtaaggctcggactaaccgttaacttcg

SEQ ID NO: 391617 - DNA, 593 bp, Homo sapiens
  misc_feature: GZ8MTXP01EBMXN.39.81.H04.1.454.CMB.2.raw
  modified_base (275)..(275): a, c, t, g, unknown or other
  modified_base (351)..(351): a, c, t, g, unknown or other
  modified_base (358)..(358): a, c, t, g, unknown or other
  modified_base (409)..(409): a, c, t, g, unknown or other
  modified_base (504)..(504): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctgggcctcagtgaaggtctcctgcaaggcttctggttacacctttaccaactatggtatcagttggtncgacacggcccctggacaagggcttgagtggatggggatggatcagcgtactttacaatggtacaacacgaaactntcgacanacgaaccctcgaaagggccaaggatccgaaccatacgaccacgaacaccanactaccaacgacgacgaacggccctaaacacgacggaccgtggacggacgacggtagagtactcgacgacgacgaccggtcgttgttactgtcgnggaagtaggagtaacggttagggttaaattgtttacgcgttacgtcccttgttaacgacgtacgggcgggtaacccgaacggtaacccg

SEQ ID NO: 391618 - DNA, 679 bp, Homo sapiens
  misc_feature: GZ8MTXP01DORWH.39.81.H04.1.454.CMB.2.raw
  modified_base (262)..(262): a, c, t, g, unknown or other
  modified_base (339)..(339): a, c, t, g, unknown or other
  modified_base (438)..(438): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatggacgagccgtgggcctcaggtgaaggtctcctgacaaggtcttctgttactacctttacaactntgtatcgtaggttggtgcgacgacggccctggaacgagggtcttggagtggagtgggatggatcgagcgtacttaanaagtcggtaacaacgtaaactaaactataccggaccaacgtaacgaaaccccgtccggaaacgggacaacggactaccaaacctagtaccgaaccaaanacgaaccacgtaacacccgaagaccgaccgaaccgtacctacgacgtacggaccgtaggacggtaccgtcggggtacgtaacgtacgtacgacggaaccgtaccgtacgggtccgttagttaacgtccggttgacggaacggtaagttacgggtaaacggttaacgggttaaatttcgttacggcgttaccggttaacccttgtaacgtacgtcggttacgggaacgttaacggtaacccg

SEQ ID NO: 391619 - DNA, 734 bp, Homo sapiens
  misc_feature: GZ8MTXP01ECEH1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcgagtgaaggtctccgtgacaaggtcttcgtagttacctaacctttaacaactatggtatcgtaggttgggtgacgacgacggccccgtaggacgaagggtcttggaggtggagtggagtggatcgagcgtacttaacgagttcggtaccaaactaactaaaactgtacgaccccaacgaacgaaccctccggaagggaacaacgtaacgtaccaaacctacgtaccgaaacccaacgaacgaacccaacaccgtaaccgaacggacgaaccgaacccggaccttaacgaacggtaccggaccgtaggaacggtacgtcccgtaaggggacgtacgttaccgacggaaccggaacgaccgggtaccgttagttacgttcgaggacgacggaaagtaagggttaacggttaacggggttaaaatttcggtttaacggaccgtttcccggttacccgtttgtttacgaaccggttacggggtaccggggacccgttaacccgggttaacccgtttccggg

SEQ ID NO: 391620 - DNA, 606 bp, Homo sapiens
  misc_feature: GZ8MTXP01A9J53.39.81.H04.1.454.CMB.2.raw
  modified_base (261)..(261): a, c, t, g, unknown or other
  modified_base (279)..(279): a, c, t, g, unknown or other
  modified_base (365)..(365): a, c, t, g, unknown or other
  modified_base (526)..(527): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggttctcctgcaaggcttctggttacacctttacaactntggtatctaggttgggtncgacgacggccccctgggaaccaggggtcttggaggtggagtggggactggatccagcgtctaacaagtgtacaactaacaaactntcgaccaacgtaacgaacccctcggaaaacgggcctaagagaccaccgtatacggaccgagggaccacgtacaataccaataccagtaccctagacgtagacctgagcgtagcgtgaagactcgagaccgacgcggtctagtatagtcgtgaagagttagnngtaacgttcttacgttcgaacgttaaggttcgggttaaggggtaattacgttacggttcggttaaccggtaaccccggg

SEQ ID NO: 391621 - DNA, 729 bp, Homo sapiens
  misc_feature: GZ8MTXP01B04U8.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctgttacacctttacaactatggtatcgagttggtgcgacacggcccctggacgaagggcttggaggtggagtgggatggatcgagcgtactttaacgaagttcggtacaacaacctaaaactagtcgaccccaaccgaacgtaaaccccgtcccgaaggggtaacccaaggtaacggtaccaaacccgtaagtaccgaaccccaacgaaacgaacccaacctaactaccccgaaacgacgaccgaacccggtaccctaacgacgtcgggaacccgtggaacggacgtacccgtagggggaacgtacgttccgttacggaaccggtaccgtacccgggtcccgtttaggttacttacggtggttacggacggaaggtaggttaacggttacggggttaaatttacggtttcgttaaccgtttcgggttacccctttggtttacgaaccgttacggtccgggggttaccgtaacggggttcccgttaaccggg

SEQ ID NO: 391622 - DNA, 688 bp, Homo sapiens
  misc_feature: GZ8MTXP01ECBDJ.39.81.H04.1.454.CMB.2.raw
  modified_base (277)..(277): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctgttacacctttacaactatggtatcgtaggttgggngcgacacggcccctggacgaagggcttgaggtggagtgggatggatcgagcgtacttaacgaagttcggtaccaacaacaaaactagtacgacccaacgaacgaaaccctcccgaggggaaccaaggtaacgtaccaaacccagtacgaacccaacgaacgaaccaccaactacccgaacgaacgaccgaaccgggtaccctaacgacgtacgggaacccgtgggaacggacgcccgtagggaacgtacgtacgtacggaccggaaccgacgggtaccgttagtaacttacggtaggtcgacggtaagaacggttaggtaacggggttaaatttacgtttacggttaccgttcggttaacccttgttacgaacgttacggcggggttacctaacggggttaacccgtcggg

SEQ ID NO: 391623 - DNA, 665 bp, Homo sapiens
  misc_feature: GZ8MTXP01DWNFU.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctcgcccgtcaccttgacagccgcctcatcctctgcaggtctagtcaaacgcctcgtatacattgatagaactctacttgaattggttcagacagacgccaggccaaatccacgaaggcgtaccttaaaatttacgtaacggtttccaaccgggtctcggtcggggtacccagacctagacttcgaggcggactaagggtcgggtcagggcaacgtgtaaacttcaaactaacgtaagaaacgtcgaaggaccggtaaggggtacgggtaagggtcgtagggtaagggttaggtttacggggtttaggggtttaagttaccgttagggacgtagtacggaacgaaacgggaaccacgtacgtacggtcccgttaccgttaccgtacggtttcggaaccggtaacgggaaccgtaacggttacgaggtaacgaacgttaaccgaaacggtaacgtgtaacggtcctacggactaaccgttaacgttccg

SEQ ID NO: 391624 - DNA, 718 bp, Homo sapiens
  misc_feature: GZ8MTXP01C4SGY.39.81.H04.1.454.CMB.2.raw
  modified_base (676)..(676): a, c, t, g, unknown or other
tcagtcgcactagtcacgaccggtgctcgattttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaagtctctgcaaggcttctgttactacctttaccaatatggtatcgtaggttggtgcgacgcggccccgtaggacgaaggtcttaggaggtggagtgggagtaggactcgaggcgtacgttaaacgaagttcggtaccaaacgtaactaaaacgttagacgaacccaaaccgaaacggtaaacccctccggaagggaaaccgtaacggtaacgtaacccaacccgtaaagtaccgaaccccaaacgacgaaacccaccaaccgacccaacggacgacccgaaacccggacctaaacgacggtacggacccgttaggacgggaacgtcccgtaaggggacgaacgtcgtaacggaaccgaacccgtcgggtaccgtttagttaacgttaacgtggtacgaggaacgtaaggttacggttaagggttaatttgttacgacgtttcgttacccgtttntacgtcgtaaccgggtcggaccgtaacgggttaaccgtccgg

SEQ ID NO: 391625 - DNA, 753 bp, Homo sapiens
  misc_feature: GZ8MTXP01BGB92.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggcttctggttactacctttaccaactatggtatcgtagttgggtgcgacgacggcccctggaccaagggcttggagtggagtgggatggatcgaagcgtacttacgaagtcggtacaactaacaaactatcgaccaacgacgaaccctcgagggaacaagggctacaaaccgtatacgaaccaacgaacaacctactaacacccgaacgacgaccgtaacggaccctaaacgaacgtcggggaacccttggggaacggacgtaccccgttagggggaaacgtaccgttccggtaacggaacccgaacccggtaaccgggtcccggtttaagttaccgttaccgtagggtacggaccgggaaaggtaacggttaacggttaaaccgggggttaaaagttttacgggttttaccggaaacggtttcccgggttaaccccgtttcggttttaaccgggaaccgtttaccggggtaccggggggttaaccccgtaaccgggggttaacccccgtttccgggg

SEQ ID NO: 391626 - DNA, 651 bp, Homo sapiens
  misc_feature: GZ8MTXP01BCGYQ.39.81.H04.1.454.CMB.2.raw
  modified_base (430)..(430): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctcctgcaaggcttcgtggttaccacctttaccaactatggtatcaggttgggtcgcgacacgggcccctaggaccaagggtcttaggaggtggagtggggactggatcgagcgtacttacgatggtaccacaactaaactgtcgacccacaacgaaccctcgagggaacagcgtcaaccgatacgaccagacgaacacgtaacncccgaacgtacgaccacgggaccctaacgagttaccggaccgtaggaacggtacgtccgtaggggaacgtactcgtacggaacccggacgtaccgggacgttacgtacttaagcggtagaccggaagtaacggaggttacgggaaatttcgtttacggacgtttcggttacccctttgttccgaacgttcggcgggggttaccaacggggttcccgttcgg

SEQ ID NO: 391627 - DNA, 757 bp, Homo sapiens
  misc_feature: GZ8MTXP01A5ODH.39.81.H04.1.454.CMB.2.raw
  modified_base (469)..(469): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctcgcccgtcacccttggacacgcccggcctccatcctcctgcaggtctagtacaaagcctagtatactattgatacggaaactaccttacttgtaatttggttacagcaggacgccaggacctaatctaccgaaggtctaccttaaagtttagtaacggtttaccgtaaccgggtacttcggtacggggtacccaagactagtacttcgaggcggacgtaagggttcgggtcagggcctaacgtagtaaacttcaaactaactagaaaactcgaacggcggtaagggggngggtaacgggtacgttaggggtaacgggtttaggtttagggggttttaagggttttaacgttaccggtacggggtacgtaaggttaaccgggaaacggtaaaccggtaaccgtaaccgttaccggttacccgggttaccccgttaacccggttaaccgtttacccgggtttaccggggaacccgggtaaacggggttaaaccgtaacggttacggtaaacggaacgttaaaccgttaacgaaaccggtaaggtcggtaacgaccgtacgacccgtaaccgttcgttcg

SEQ ID NO: 391628 - DNA, 663 bp, Homo sapiens
  misc_feature: GZ8MTXP01ADWUL.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctctgcagcttctgtactaccttacaatatgtatcgagttggtgcgtacgacggcccgtggaccgaaggtctggaggtggagtggagtggatcgagacgtactaacgagttcggtacaaactaacaaacttgtacgacccaacgaacgtaacccgtccgaagggtaaccaacggaacgtaccgaaaccgtataccgaaccaacacgaacaactacacccgaacgacgacccgtaaccgacctaacgacgtacggacccgtaggacggacgtaccgtaggggacgtacgttcgacgaccgtacgaccggtcgttagttactacgtaggtcgaacggtaagaggttaacggttacgggttaaatttcgtttacggacgttaccgttccttaacgttacgaaccgttcggggtaccgggacgtaaccgggttaacccgtcgg

SEQ ID NO: 391629 - DNA, 803 bp, Homo sapiens
  misc_feature: GZ8MTXP01BK39N.39.81.H04.1.454.CMB.2.raw
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggtcttctggttacacctttaccaactatggtatcgtaggttggngcgacgacggcccctaggacgagggtcttggagtggagtgggaatggatcgagcgtacttaacgaagttcggtacaactaactaaaactgtacggacccaaccgaacgtaacccgtaccgaggggaacctaaaggccgttaccaaacccgtagtaaccgaaaccccgaacgaaacgtaaacccaacccacgtaccccgaacggaacgacccgaacccggtacccgttaacgacgttaccgggaacccgttagggaaccgggtacgtaccgtaggggaacgtacgttaccgtcgggaaaccgaccggtaccgggttaccgttaacggtttacgtttacggtcggttacggaaccgggtaaaggtaagggttaaaccgggttaacgggggtttaaattttacgggtttaacgggttaaaccggttccgggttttaaaccccgtttcggttttaaccggtaaccgggttttaaccggggccccgggggttaaccgggtaacccggggttttaaccccggtaaccccgggg

SEQ ID NO: 391630 - DNA, 636 bp, Homo sapiens
  misc_feature: GZ8MTXP01C51OK.39.81.H04.1.454.CMB.2.raw
  modified_base (390)..(390): a, c, t, g, unknown or other
tcagtcgcactagtcacgaccggtgctcgatttagtagtgtagattcgcgggtgatcaggactcctcagttccaccttctcacaatgaggctccctgctcagctcctggggctgctaatgctctgggtcccaggatccagtggggatgttgtgatgactcagtctccagtctccctgcccgtcacccttggacacgccgcctccatcctcctgcaggtctagtcaaagtctacgtatacattgataggaaacaccttatgtaattggttcagcaggacggccaggccaatcctacgaaggtccgtacctttaaattttaagtaacggtttccgtaacccgggtactcggtcggggtacccagacagtactcgagcggctaggtcgggacngggcacgtagaacttcaacgtataagaaatcgaaggcggaggggtaggaggcgtaggaggtagttgggttaggggtttattacgtgacgtagtaggaacgaaacggtaacaccgtcgtaccggtaccgttccgttagttaaccgtttcgggaccggtaacggggaccaagggtccgttagggaacgtacttaaaccgaacggttacgtgggtggtaaccgtcgaccttacctaacttcgtttaacg

SEQ ID NO: 391631 - DNA, 620 bp, Homo sapiens
  misc_feature: GZ8MTXP01DWLFD.39.81.H04.1.454.CMB.2.raw
  modified_base (214)..(214): a, c, t, g, unknown or other
  modified_base (262)..(262): a, c, t, g, unknown or other
  modified_base (267)..(267): a, c, t, g, unknown or other
  modified_base (271)..(271): a, c, t, g, unknown or other
  modified_base (276)..(276): a, c, t, g, unknown or other
  modified_base (283)..(283): a, c, t, g, unknown or other
  modified_base (286)..(286): a, c, t, g, unknown or other
  modified_base (292)..(292): a, c, t, g, unknown or other
  modified_base (396)..(396): a, c, t, g, unknown or other
  modified_base (445)..(445): a, c, t, g, unknown or other
  modified_base (480)..(480): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgaagtctcgtgcaggtcttcgtgttactaccttacatatgtatcngtggngcancgccngagaggntgngtgagnggatggatcgacgtcgtacttaacgaagttacggaccaaacaaactaaacgtctacgacccaacgaacgaaccctccgacggtaacaacgtcgaccaaccgtanacgaacccacgacgactacacaccgacggactcccgaacggtccctaanacggtacggacgacggaggacgtaccgagaacgtntaccgcggaaccgaccggacggtacgttagtccttaggtcgcggtagaagtaaggacgggttacggttaaatttcgttcggacgttccgttaccgttgtagtaaccgttaacgggcggacgtaaccggttaacccgtcgg

SEQ ID NO: 391632 - DNA, 626 bp, Homo sapiens
  misc_feature: GZ8MTXP01BTGW8.39.81.H04.1.454.CMB.2.raw
  modified_base (345)..(345): a, c, t, g, unknown or other
  modified_base (351)..(351): a, c, t, g, unknown or other
  modified_base (383)..(383): a, c, t, g, unknown or other
  modified_base (391)..(391): a, c, t, g, unknown or other
  modified_base (507)..(507): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctgttacaccttacaactatggtatcgaggttgggtgcgacacggcccctggacaagggtcttggaggtggagtgggatggatcgagcgcttacaagtggtacacaanaaactntgaccacagaaccctcgaggacagcgtcacancgaaccanacgacacactaccaacggacgcctacggaccctaacgacgtacgggacctagggacggacgcccgtagggacgtacgttcgacgaccgaccgacgggtaccttaggtactttacgnggtcggacggaaggtaggttaaggttaacggggttaaattcggtttgttaacgttccggttacccttcgtttagaaccgttacgggtacggggacccgtaacgggttaacccgtccggg

SEQ ID NO: 391633 - DNA, 663 bp, Homo sapiens
  misc_feature: GZ8MTXP01CUF6J.39.81.H04.1.454.CMB.2.raw
  modified_base (271)..(271): a, c, t, g, unknown or other
  modified_base (353)..(353): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgcaaggcttctgttacaccttacatatggtatcgagttggngcgacgaggcccctggacgaagggtctgaggtggagtgggatggatcgagcgtacttaacaagttggacaacaacgaaactntacgaccaacgacgaacctaccgacgggaacagaacgtaccaaccgatacgaccaacacgaaccacgactaccgacgacgaccgaccggacctaacgtacgtacgggacctgggaaacggcgtaccgtagggacgtacgttccgacggaccgaaccgtaccggtacgttagttacttaccgtgtcggagaagggtaacgaagggttaacggggttaaatttacggtttccgacggtttccggttaccttttcggttacggtaaccgttagggtcccggggaccgtaaccggggttaacccgtttcccggg

SEQ ID NO: 391634 - DNA, 676 bp, Homo sapiens
  misc_feature: GZ8MTXP01BGHK4.39.81.H04.1.454.CMB.2.raw
  modified_base (291)..(291): a, c, t, g, unknown or other
  modified_base (324)..(324): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtcctccctgccccgtcacccgttggacacgccggcctccatctcctgcaggtctagtacaaagcctagtatacattgaataggaaacacttacttgaattggttcagcagagcagccaatcncgaagcgacttaattagtaaggttctaaccggntcgtgggtacccagacagtacttcagtcggacgaggtagggtaagcactacgtaaattcgaactacgtagaaaactcgaaggcggtaaggggtagggacgggtacggtagggtaaggggttagtttagggggttttagggggtttaacttagttacggtaccgtaaggggttacggtaaacgaaaaccgggtaaacaccggtaaccgtccggtccccgtttaaccggttacgttaaccggttttcgggaacccgggtaacgggggaacccaaaggcgttagggaaacgtaacgtaaacgaaacgttaacgttggtgggtacctcgaacctaccttactttcgttcgtttccc

SEQ ID NO: 391635 - DNA, 656 bp, Homo sapiens
  misc_feature: GZ8MTXP01A3GBE.39.81.H04.1.454.CMB.2.raw
  modified_base (215)..(215): a, c, t, g, unknown or other
  modified_base (252)..(252): a, c, t, g, unknown or other
  modified_base (265)..(265): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctnagtgaggtctctgcagtcttctgttactacttacatntgtatcgagtggngcgacgacgccctggacgaggtcttgaggtggagtgggatggatcgagcgtacttacagtcggtacaacaactaaactgtcgaccacacgaaccctcgaggacaagcgtaccaacacgtaccgaccaacgacgaaccacacgtacccgacgacgaccgaccggtacctacgacgtacggaccagggaacggacgtccgagggtacgtacgttaccgacggaaccgaacgtccggtacgttacgttacgttacggtgtacggtaggaacgtaaggttacgggttaaacgggttaaattttacggtttcgttaacgtttccggttacccgtttgttacgggtaaccgttacggggtccggggttaaccgtaaccggggttaacccgttccggg

SEQ ID NO: 391636 - DNA, 650 bp, Homo sapiens
  misc_feature: GZ8MTXP01BX8GM.39.81.H04.1.454.CMB.2.raw
  modified_base (355)..(355): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacaactatggtatcaggttgggtgcgacacggcccctggacaagggtcttggaggtggagtgggatggatcgagcgtctttaacaagttggtacacaacaaactntcgacccaacacgaaccctccgagggacagcgtacaccatcgaaccacgaacgacaccatacccacggacgaccgaaccggtaccctaacgagtaccgggaccctagggaacggtacgtcccgtaggggacgacgtcgtacggaaccgaccgtacgggtccgttagttacgttacgtggtcggacggaaggtagttaacggttacgggttaaatttcgtttacgttaccgttcggttaccccttgtttacggaaccgttacggtcggggacccgtaacgggttaacccgttccgg

SEQ ID NO: 391637 - DNA, 659 bp, Homo sapiens
  misc_feature: GZ8MTXP01B9S1K.39.81.H04.1.454.CMB.2.raw
  modified_base (216)..(216): a, c, t, g, unknown or other
  modified_base (255)..(255): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctnagtgagtctctgcagtcttcgtgttactaccttacaatntgtatcgtagtggtgcgacgacggccctaggacgaggtctagaggtggagtggagtggatcgagtcgtactttaacgaagttacggtacaaacaaacgtaaaacttagtacgaaccctaacggaaaccgtaacccgtaccggaacggggtaacaacggaacgtaccaacctaagtaccgaaacccaacgacgaacacctacgacccgacggacgaccgaaccggtacctaacgtacgtacggaccgagggaacggtacgaccgtaggagtacgtcgacggacgacgaccgtcgtatacgtacgtgacggagaagaggttaggttaacgggttaaattcgtttcgacgttccgttaccttgttaggtaaccgttgggaccggttacgtaaccggttaacgttccg

SEQ ID NO: 391638 - DNA, 668 bp, Homo sapiens
  misc_feature: GZ8MTXP01A70UW.39.81.H04.1.454.CMB.2.raw
  modified_base (369)..(369): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcgaaggtcttctggttactacctttaccatatggtatcgaggttggtgcgacgcggcccgtggacgaagggtcttggagtggagtggggatggtatcgagcgtacttaacgaagttcggtacaacgtaacaaactntaccgactaacgaacgaaccctccggaaaggggacaacggtacgtacctaaaccagtaccgaacccaacgaacgaaccaacaactacccgaacgaccgaccgtaccggacccttagacgttacgggaaccctgggaacggaccgaccggttaggaacggtaacttccggaacggaacccgtacggtaccggtaccgttagttacttacgttggacgaacggaggacgtaggttacgggtaaatttgttacgcgttcgtaaccttgttcgacgtcgttgggaaccgttaagggtaacccg

SEQ ID NO: 391639 - DNA, 752 bp, Homo sapiens
  misc_feature: GZ8MTXP01A9P60.39.81.H04.1.454.CMB.2.raw
  modified_base (272)..(272): a, c, t, g, unknown or other
  modified_base (458)..(458): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctctgcaaggtcttctgtactaccttacaactatgtatcgagttggngcacgacggcccgtggacgaaggtcttaggagtggagtgggatggatcgagcgtactttaacgagttcggtacaaacgaactaaaactagtacgaccccaaacgaacggtaaaccctacggaacggggacaaacggtctacccaaaccgtaaataccggaaaccaaacgacgaaaccacccgtaanaccccgaaacggacgacccgtaacggaaccccttaacgaggtaccgggaaccgtagggaacgggtaaccgacccgttagggggaacgttaactaccggtacggaaaccggaccggtaaccgggaccggtttaggttacttaccggtagggtacggaaggtaaagggaaggttaacggggtaaagggtttaaacgtttcgttttaacggccgttttacgggttacccctttgttaacggtaaccggtttacgggacgggggttacccgggtaacgggttaaccccgtttaacggg

SEQ ID NO: 391640 - DNA, 719 bp, Homo sapiens
  misc_feature: GZ8MTXP01CNXUX.39.81.H04.1.454.CMB.2.raw
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgagtgaggtctcctgcaaggcttctgtacctacttacaatatggtatcgagttggtncgacgcggccctggacaaggtcttggagtggatgggatggaatcgaggtcgtcttaagaagtggtacaacaacctaaaactgtacgacccaaccacgaaccctccggaaggggaaccaaggaacgtacaaacccgatacgaaccacgactaaccgacacctaccgaacggagccgaaacgtaccctagaacgtcggaccgaggacggtacgcctaggggacgttaacgccgtaaggaacccggacgtaccgggtacgtttacgtacgtttaccgtaggttcggaaccgggtaaggtaaacggttagggtttaaacccgggggaaattttttacggttttaccggaaacgttttcccggggtttaaccccgtttaacgtttgggtaaccccgtttaacgggggttccccggggaaccgggttaaccccggggttaacccggttcccggg

SEQ ID NO: 391641 - DNA, 720 bp, Homo sapiens
  misc_feature: GZ8MTXP01ASFKW.39.81.H04.1.454.CMB.2.raw
  modified_base (385)..(385): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctcgcccgtcacccgttggacacgccgcctcatcctctgcaggtctagtacaaagtcctagtatactattagatacggaaactactacttagaatttggtcagacgagacggccaggacccaatcctacgaacggctaccttaaagtttacgtaacggtttaccgtaaccggtctcggtcgggtaccagactacgtatcgaggccgngtaagggtcgggtcgacgggtacctaacgtacgtaacgttacaaacgtaacgtaaagtaaaactcggaaggtaccgggaagggggtacgggaacgggtcggttagggtaaagggttaggtttaggggttttaaggggtttaactttacggtaggtacgtaagttacggaacgtaaaacggacctacgtaccggttaccggtacccttaccggtactttaccgggttccggaaccgggtaaccggggttaacgtacggacggttacggaacggttaccttaaaccgaaacggttaacgtcgggtcgaacgtcgaccctaacggttaacgtttcccg

SEQ ID NO: 391642 - DNA, 748 bp, Homo sapiens
  misc_feature: GZ8MTXP01A0S4Y.39.81.H04.1.454.CMB.2.raw
  modified_base (236)..(236): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaagtctctgcagtcttntgttactacctttacactatgtatgtaggtggtgcgacgacggccccgtaggacgaagggtcttaggaggtggagtgggagtgatcgagtcgtacttaacaagttcggtaccaactaaacctaaactagtaccgaacccaaccgaacgaacccgtacggaacgggacaaagtccgacaaccgaagtacccgaacctacgaaacgaaccctaacaacgacccgaacgacgacccgtaacgtaccctaaacgacgtaccgggaacgtcgggaaacggtaccgtaccgtagggaacgttacgttaccgaacgggaaacccgaaccgaccgggttacgttaacgtaacgtttaaccgccgggttaggaaaccgggaaggtaaaggttaccgggtttaaaggttaaaccgttttaggttaacccggttaccggttaccgggtttaccccctttaaggttacggtaaccgttacggggaccgggttacccggtaaccgggttaacccgttaacccggg

SEQ ID NO: 391643 - DNA, 662 bp, Homo sapiens
  misc_feature: GZ8MTXP01ARUUP.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttcgtaggttacctaacctttaccaaacttagtggtatcgtaggttgggtgacgacgacggcccctggacgaagggcttggaggtaggagtgggacgtggatcgaggccgtactttaacgaagttcggtacaacaaaccgtaaactatcgacccaacgaacgaaccctccggaagggaaccaacgggtaactaccaacctaagtacgaaccaaccaaagaaccaacctacaccgaacgacgaccgacggaccctacgacgtacgggacgtacgaggacgccgtaggagtacgtcgacgaccgacgacggtacgttagtagtccgtgtgacggaagtagacggtagggttaaattggttacgcgttaccgttccttaacgttcgaacgttacggtccgggaccgtaacgggttaacccgtaaccgg

SEQ ID NO: 391644 - DNA, 648 bp, Homo sapiens
  misc_feature: GZ8MTXP01DSQFB.39.81.H04.1.454.CMB.2.raw
  modified_base (253)..(253): a, c, t, g, unknown or other
  modified_base (259)..(259): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcagtcttctgttacaccttacatntgtatnagtggtgcgacgcgccctggacgagggctgagtgagtggatggatcgagacgtacttacgattcggacaacaactaaactgtacgacccgacacgaccctcgacggacacgcgtacaaccgataccgaaccacgacgaccaacacgtacccgaagacgaccaccgtacctaacgacgtacggacctcggaaggtcgaccgtaggggacgtacttacgacggaaccgtcgaccggtccggttattacgtttacgtggtcgaacggaaggtaaacggttcggttaaacggggttaaattttacgtttacggacgttttccggttaccccgttgtttacggtaaccgttccgggacggggttaccgtaacccggggttaaccccgttccggg

SEQ ID NO: 391645 - DNA, 766 bp, Homo sapiens
  misc_feature: GZ8MTXP01D6XLM.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgacaaggtcttcgtggttacctacctttaacaactagtggtactcgtaggttgggtcgacgacgacggccccgtaggacgaagggtcttaggaggtggagtaggggatggatcgacggtcgtacttaacgaagttcggtaaccaaacgtaaacctaaaacgttagtacgaacccctaaaccgaaaccggtaaaccccgtcccgggaaacgggggacccaaacgggtaacggttacccaaacccgtaagtaccggaaaccccaaacgaacgtaaacccaacctaaccgtaacccgaaaccggtaacgaacccgaacccggtaaccctaaacgtaacggttacccgggaaacccgtagggaaacgggacgtacccgttaggggaacgtacgtacgtacggaaccgaccgtacggtccgttaagttacgtcgtgtcgagaaggtaacgttaggtaacgggttaaatttagtttacgaccgttcggttaccttgttacgtaaccgtacgggtcgggaccgtaaccgggttaaccgttcgg

SEQ ID NO: 391646 - DNA, 730 bp, Homo sapiens
  misc_feature: GZ8MTXP01DJOHI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctcgtgacaaggtcttcgtggttactaccctttaccaactagtggtatcgtaggttggtgccgacgacggccccgtaggacgaagggtcttggaggtgagtggatggatcgacgcgtacgttaacagttcggacaaacgaactaaaatcgtacgacccctaaacgacgtaacccgtacggacggggaaccaagtccgtaccaaccgaataccgaaacccacgaacgaaccaccgtaacacccgaacgacgacccgaccgtaccttaacgacggttaccggaaccgtacggaaggccgaccgttagggaacgtacgttaccgtaacgggaaccgaacccggaccgggttaccgtttacgttaacgttcgtaggttaacgcggtaaaggtaaggttaaaccggggttaacgggttaaattttaccggtttcgaaccgttttccgttacccgtttgttacgtaacggttaccgggtacgggaccggtaaaccggttccccggttaacgg

SEQ ID NO: 391647 - DNA, 639 bp, Homo sapiens
  misc_feature: GZ8MTXP01A1T1J.39.81.H04.1.454.CMB.2.raw
  modified_base (255)..(255): a, c, t, g, unknown or other
  modified_base (537)..(537): a, c, t, g, unknown or other
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaaacctgggcctcagtgaaggtctcctgcaaggcttctgttacacctttacaactntggtatcagttgggtgcgacaggcccctggacgaagggcttggaggtggagtgggatggatcagtcgacttaacgaagtggtacaacaacaaactatcgacaaccgacgtaaacctccgaaggggcaaacggtacgtaaccaacccgtatacgaacccaacgacgaacaacactaccgaacggacgccaaccgggaccctaacgacgtacgggacctaggacggacgccgtagacggactcgtacgaccgacgaccgggtccgttagtacttacgtggtcgnggaagaaggtaggttacggggtaaatttgtttacggacttcggttacccttgttaacggacttaacggtcggggtaccgacgggtaacccgttggtaacccg

SEQ ID NO: 391648 - DNA, 650 bp, Homo sapiens
  misc_feature: GZ8MTXP01CDL4P.39.81.H04.1.454.CMB.2.raw
  modified_base (265)..(265): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctcctgcaggtctagtcaaagcctagtatacattgatggaaacactatgaatggttcagnagaggcaggcaatctaccaaggctactaatttataaggtttcaaccgggctcgtggggtacccagacagacttcgaggcggcaggtgggtcaaggctacgtagaaacttcaaacacttaagaaaactcgaaggacggagggtagggaggtacgtaggaagggtagttagggttaggggtttaacttacgttagacgtaagtacggaacgaaaacgggaaaccaaccgtaacgttcggtaacccgttcccggttaaccgttaccggttttacgggacccggtaacgggggaaacccttaagggtccgttagggaaacgtaacgttaaccgaaaacggttaaccgttggtacggtccgtacggaccgaaccgtaacttaacgttccg

SEQ ID NO: 391649 - DNA, 718 bp, Homo sapiens
  misc_feature: GZ8MTXP01CY91I.39.81.H04.1.454.CMB.2.raw
  modified_base (238)..(238): a, c, t, g, unknown or other
  modified_base (253)..(253): a, c, t, g, unknown or other
  modified_base (268)..(268): a, c, t, g, unknown or other
  modified_base (349)..(349): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctctgcaggcttntgtacaccttacatntgtatcgaggttggngcgacgacggcccctggacaagggcttgaggtggagtgggatggatcgagcgacttacaagttcggacacaaactaaactntcgacccacgaacgtaccacgagggaacagtcgtacaacgatacgaccacagaccacactccgaacgacgtaccgacggacctaacgagtacgggaaccgtaggaacggacgtcccgttaggggaacgtacgttaccgaacggaaccggaacccggtaccgggtacccgtttagtaaacgtttccggaggtacggacgggtaaagggtaacgggttaaacggggttaaaccggggttaaagttttaacggtttaccggttaaccggttttacccggtttaccccgtttaacggtttaaccgggtaaccggttaacccgggggttaccgggggttaccccggttaacccggggttaaccccgttaacggg

SEQ ID NO: 391650 - DNA, 659 bp, Homo sapiens
  misc_feature: GZ8MTXP01AK2B8.39.81.H04.1.454.CMB.2.raw
  modified_base (563)..(563): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgtaggttgggtgcgacgacggccccgtaggacgaagggtcttggaggtggagtggggatggatcgagagtcttacgagtcggtcaacaacaaactatcgacccaacagaaccctccgagggaacagaacgtccaaacccagtcgaacccaacgacgaactaacgactacccgaacgacgacccaccgggtaccctaacgacgtacgggaacctgggaacgggacgtcccgtagggaaacgtacgtccgtacggaaccggcgtaccggtccgtagttactacgtgtacgcggtaagnggttaacgtacggggttaaattacgtttgacgttcggttacccttggtttagaaccgtttacgccggggttaccgtaacgggttaaccccgttcgg

SEQ ID NO: 391651 - DNA, 602 bp, Homo sapiens
  misc_feature: GZ8MTXP01CL91T.39.81.H04.1.454.CMB.2.raw
  modified_base (236)..(236): a, c, t, g, unknown or other
  modified_base (251)..(251): a, c, t, g, unknown or other
  modified_base (426)..(426): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcagcttntgtacaccttacatntgtatcgagttggtgcgacaggcccctaggacaagggcttggagtggagtgggatggatcgagcgtacttacgaagttggtacaacgtaaacaaactgtgacccaacacgaaccctcgagggacagcgtcacatcgaaccacaagacacataccgacgacgccacggcctaacgngtacgggacctgggaagacgcctaggacgtactcgtagaccgaacgccggtaccgttagtacttcgtggtgcgaaggtaacggagggttacgggaaatttcgtttcggacgttccggttaccctttgtacggtaacgttacgggtcggggaccgtaacgggttaacccgttccggg

SEQ ID NO: 391652 - DNA, 766 bp, Homo sapiens
  misc_feature: GZ8MTXP01B9OXP.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctccgtgcaaggtcttcgtggttacctacctttaaccaactatggttatcgtaggttgggtcgacgacgacggccccgtaggaacgtaacgggtcgttaggaggtggagtggggtagtgggatcgaggtcgtacttaacgaagttcggtacaaactaaacaaacttgacgacacgtaacgaaccctcgagggaacagtaacgtacaaaccactacgaacccagacgaactaccaacacccgacgacgtaccgacggtaccctaacgagtaccggtaccgtagggaacggacgtacccgtaggggtaacgtacggttaccgaacgggaaccggaaccccggtaccggggttaccgtttaagggttaccttaaaccgggtggttaaccgggacgggtaagggtaaaggttacccggggttaaacgggggttaaaatttttacggtttaccggttaccggttttcgggttacccctttgggttaccgtaacggttaccgggtacggggttacccgtaaccgggggttaaccccttaaccgggg

SEQ ID NO: 391653 - DNA, 584 bp, Homo sapiens
  misc_feature: GZ8MTXP01BNM5B.39.81.H04.1.454.CMB.2.raw
  modified_base (390)..(390): a, c, t, g, unknown or other
  modified_base (450)..(450): a, c, t, g, unknown or other
  modified_base (546)..(546): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcaagcgctttaacaaagttggtacaacaactaaaactatcgacccaacaagaaaccctcgaaggggacaagngtcaaacccgatcgaacccaacagaaccacaactacccaacgacgaccacggacctacancggacctgaaggaagccgtaggagatctagacacgacggctagtactacgtgtgcgaagagagtacgggaaatagttttagacgttcgttaccctnttcggaacttacgcgggcctaacgggttaacccgtggg

SEQ ID NO: 391654 - DNA, 680 bp, Homo sapiens
  misc_feature: GZ8MTXP01B4EJS.39.81.H04.1.454.CMB.2.raw
  modified_base (332)..(332): a, c, t, g, unknown or other
  modified_base (448)..(448): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgacgaaggtcttcgtggttacctacctttaaccaacttagtggtatcgtaggttgggtgcgacgacggcccctggacgaagggtctaggagtggagtggggntggatcgagcgtactttagaagttggtacaaacaaactaaacgtgtcgaacccacgtaacgaacccgtaccgaggaaccaagcgtacaaaccgatacgaaccaacgagaaccctanactaccgaacgacgaccgtaccggacctaacgaacggtcggaacccggtggggacgtacgtacggacgacgttcgacggaacccggtacgtaccggtcccggttattaaaccgttcgtggtacgacggtaagaaggtaaaggttacggggtaaattcggtttactacggttcgttacccttgtttaacgacgttaaccggtacgggacgaccgggtaaccgttgtaaccccg

SEQ ID NO: 391655 - DNA, 770 bp, Homo sapiens
  misc_feature: GZ8MTXP01DCUCY.39.81.H04.1.454.CMB.2.raw
  modified_base (337)..(337): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctggagatgacggaagccgtggggcctcgagtgaagtcctctgacagtcttcgtagttaccacctttaccaacttagtggtatcgaggttggtcgacgtacgcggccccgtaggacgaagggtcttggaggtggagtgggtatgganccgagcgtacttaagagttcggactaacaactaaactgtacgaccccaagacgtaacccgtacgacgggaacaagtcgtaccaaccgtagtacgaacccaacggacaacccaactacgtacccgaaacggacgacccgaaccggacccttaaacgacggttacgggaaccccgaagggaaccggtaaccgtaccgttaggggaaccttaaccgttcggaaccggaaaccggtacccggaacccgggttaccggttagtttaaccgttacgtaccgggttaggaaccgggtaaagggttaaacggagggtttaaacggggttaaaacttttcgggtttcggttaaccccgtttcgggtttaacccctttaagggttacgtaaccggttcccgggggaccggggttaaccggtaacccggttaacccggttccgg

SEQ ID NO: 391656 - DNA, 667 bp, Homo sapiens
  misc_feature: GZ8MTXP01DNPMR.39.81.H04.1.454.CMB.2.raw
  modified_base (570)..(570): a, c, t, g, unknown or other
  modified_base (624)..(624): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgacaaggcttctgttactacctttaaccaacttatggtatcgtaggttgggtgcgacgacggccccgtaggacgaagggtcttggagtggagtgggatggatcgagcgtacttaacaagttcggtacaacgaaactaaaactagtacgaaccaaccgaaacgaacccctacggaagggaacaacgtaacgtaccaaacccatacgaacccaacaacgaaacccaacaactacccgaaacggacgaccctaaccggacctaacagtacgggaccctagggacggacgacccgtaggggaatacgtcgacgaaccgaaccgaccggtccgtagttacttacgngtagacgaagaacgacggtaaggttaaattagtttcgacgttcgttaccccttnttacgtaacttacggcggggttacctaacggttaacccgtcgg

SEQ ID NO: 391657 - DNA, 787 bp, Homo sapiens
  misc_feature: GZ8MTXP01DAN84.39.81.H04.1.454.CMB.2.raw
  modified_base (288)..(288): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggcttcgtggttactacctttaccaacttatggtatcgtaggttgggtcccgngacgacggcccctggacaagggtcttggagtggagtgggatggatcgagtcgtacttacgaagttggtacacgtaactaaaacttgtcgacccaacaacgaccctaccgacggggtaccaagtaacgtaccaaccataccgaacccacaacgaacccactagacccccgaaggacgtaccaacccgggacccttaagaacggttaccgggacccgttagggaacgggtaaccgtcccgtaagggggaaacccgtgttacccgtagggaaacccgtaaccggtacccggggaccggttttagttaaacgttttcccggtgggtacgggaaccggtaaagggtaaacgggttaaacggggtttaaaccggggtttaaactttttacggtttccgggttaaacccgttttcccgggtttaacccctttaaggtttaaccgggtaacccggttaccggggtacccgggggttaaccccgtaaccggggttaaccccgttcggg

SEQ ID NO: 391658 - DNA, 743 bp, Homo sapiens
  misc_feature: GZ8MTXP01AETQA.39.81.H04.1.454.CMB.2.raw
  modified_base (273)..(273): a, c, t, g, unknown or other
  modified_base (295)..(295): a, c, t, g, unknown or other
  modified_base (362)..(362): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctcgcccgtcacccgttggacacgcccggcctcatcctcctgcaggtctagtacaaacgtcctagtatacattgatacgaaactacctatgaagttgtnagcagaggccaggcaatctaanacggtctacttaagtttacgtaaggtttcaaccgggctcgtcggtaccagacagtatcaggtcgagnggtaacgggtcaaggtcaacgttagaactttaccgaacgtaacgtaaagtaaactacgaacgggtcgggaagggggtggtaacgggaccgttaggggtaacgggtttaaggttttacgggggttttaaagggggttttaaccttaagttaccgggaacttaagggttaaccggaaaccggtaaaaccgggaaaaccctaaccgtacggttacccggtaccccggtttaccgttaacccggtttaaaccggtttacccggggaaccgggtaaacgggggaaaccccttaaagggtaccgaagggtaaacgtaaccggttaaacgaaacggttaacggtgggttaacgccgttacggacttaaccttaacgttccgttaaccg

SEQ ID NO: 391659 - DNA, 819 bp, Homo sapiens
  misc_feature: GZ8MTXP01A17VY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcgagtgaaggtcctctgacaaggtcttcgtcggttacctaccctttaaccaacttagtggtatcgtaggttgggtgccgacgaccggccccgtaggaacgaagggtctaggaggtggagtggggatggatcgagtccgtacttaacgagttcggtaccaactaaacaaactgtacgacccaacgacgtaacccctcggacgggtaacaacgaacgtaccaaaccgtaagtaccggaaacccaacgaacgaacccaacctaacgtaccccgaacgacggaaccccgttaacggaaccccgttagaaccggttcgggaacccgttacgggaacggtaaccgtcccggaaggtacgtaccgttacggtaaccggaccgtaccgggtacccggtacggtttaacgttaacgtttccgggtaggtacgggaaccgggtaaaggacgggtttaaacggggttaaaccgggttaaagtttttcggtttaacccggttaacccgggtttccgtttaacccccggttttaaggtttaccggtaaaacccgggtttccgggggtacccggggttaccccggggtaaaccggggttaaccccgttttcccggggg

SEQ ID NO: 391660 - DNA, 688 bp, Homo sapiens
  misc_feature: GZ8MTXP01BV61J.39.81.H04.1.454.CMB.2.raw
  modified_base (283)..(283): a, c, t, g, unknown or other
  modified_base (302)..(302): a, c, t, g, unknown or other
  modified_base (355)..(355): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctggttactacctttaccaactatggtatctagttgggtgcgacncggccctggacaaggctgnggtggagtgggatggatcgaggcgtcgttacaagtggtacaactaacaaatanacgtccaacgacgaacccgtcgagggaacagtaacgtacaaccataccgaacccaacgacgaccaacgtaccaccgacgacgtaccaacgggaccctacgagttacggacccgttagaggacgccgagggacgaacgttccgacgacggaccgtaccgggtccgtaagttcgttaacgtcggtcggcgaaaggtaggttaacggtaccggggttaaaattttagggttttacgttaaccggtttcgggttaaccccttttaaggttaacggtaacccggtttaacgggggaccggggttacccggtaacggggttaaaccccgtttcccgggg

SEQ ID NO: 391661 - DNA, 629 bp, Homo sapiens
  misc_feature: GZ8MTXP01D0ZVQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacaactatggtatcgaggttgggtgcgacaggcccctggacaagggcttgagtggatgggatggatcgagccgctttaacgaagttggtccaacaacaaaacgtatcgacccaacacgaaaccctccgaaggggccaagaacgtccaacctatacgaaccaacagaaccacaactacccaacgagaccgtaacggaccctaacagtacggacctagaggacgccgtaggagtatcgagaccgacgacggccgtagtacttacgtgtcgcgaaggtaagaggttacggggttaaaatttagttttcggaaccgttcggttaacccctttgttacgtaaccgttacgggtccggggaccgtaaccgggaacccgtttccgg

SEQ ID NO: 391662 - DNA, 690 bp, Homo sapiens
  misc_feature: GZ8MTXP01DHQX4.39.81.H04.1.454.CMB.2.raw
  modified_base (250)..(250): a, c, t, g, unknown or other
  modified_base (262)..(262): a, c, t, g, unknown or other
  modified_base (476)..(476): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcggctggtacagtctggagctgagatgacgagccgtgggctcagtgaggtctctgcagtcttctgttactaccttacatntgtatcagtggngcgacacggccctggacgaggtctagagtggagtgggatggatcgagtcgtacttaacgaagtcggtacaacaaactaaacgtatcgaccaaacccgaacgtaaacccgtacgaacggggacaaaaggtaccgtccaaacctagaccgaacccaacacgactaacactacccgaacgacgaccgacccggacctaacgacgtacgggaacccgnggacggacgacctaggacgggtacttcggaacgaaccgaccggtaccggtccgtttagttaaacttcgtagggtacggacggtaaggaacggttaaacggttaacgggggtttaaatttaggtttaccggtaacgtttacccgggtttccctttacggtttcgaaaccgttcggtacggggacccgttacgggtaaccccggttcgtaaccccg

SEQ ID NO: 391663 - DNA, 676 bp, Homo sapiens
  misc_feature: GZ8MTXP01C87KQ.39.81.H04.1.454.CMB.2.raw
  modified_base (216)..(216): a, c, t, g, unknown or other
  modified_base (240)..(240): a, c, t, g, unknown or other
  modified_base (260)..(260): a, c, t, g, unknown or other
  modified_base (402)..(402): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagcctggggcctnagtgaaggtctcctgcaaggcttntggttacacctttacaactntggtatcgagttggtgcgacacggccctggacagggcttgagtggagtggggatggatcgagcgcttacaagtggtacacacaaactatcgacacagaaccctcgaacgggacaagactacaccgatcgaccacgacgacanactcacgagaccaacggcctaacgagtacggacctaggaacggacgtaccggtagtaaggacttacccgtagaacccggtacgtacccgggtacccgttagttaaccgtttaacgtcgggttggaaccgtaagggaacggttaagggttaaaccgggggtaaaagttttacgttttacgggttaaacgttttcccgggttaaacccgttttcgttttaacggaccgtttaaccgggttaccgggggtaacccgttaacgggggttaaacccccg

SEQ ID NO: 391664 - DNA, 730 bp, Homo sapiens
  misc_feature: GZ8MTXP01DGND7.39.81.H04.1.454.CMB.2.raw
  modified_base (373)..(373): a, c, t, g, unknown or other
  modified_base (412)..(412): a, c, t, g, unknown or other
  modified_base (419)..(419): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaaacaacaggtgcccactcccaggttcagctggtacagtctggagctgagatgacgagccgtggggcctcgagtgaaggtctcctgcaaggtcttcgtggttacctaccttaccaacttatagtatcgaggttgggtgacgacgacggccccgtaggaacgaagggtcttaggagtggagtgggatggatacgagcgtacttactaagtcggtacaactaacaaatntacgacacgacgaaccctcgaaaggcaagacgtccacancgaacanacgacacacaccgacgacgtaccgacggtaccctaacgtacgtacggtaccgtagggaaccgggtaccgtaccgggtacggaacgtaaccgttacccgtaaacgggaaccccggtaaccggacccggggttaccgtttacggtttaaaccgtttaccggtagggtacggtaacgggaaaggttacggggtaaacgggttaagggggttaaaacttttcggtttaaccgttacggtttacccggttaaccgtttacgtttaacggtaacccgtacggggttaccgggtccggttaaaccggggttaaccccg

SEQ ID NO: 391665 - DNA, 546 bp, Homo sapiens
  misc_feature: GZ8MTXP01EH08O.39.81.H04.1.454.CMB.2.raw
  modified_base (251)..(251): a, c, t, g, unknown or other
  modified_base (282)..(282): a, c, t, g, unknown or other
  modified_base (308)..(308): a, c, t, g, unknown or other
  modified_base (327)..(327): a, c, t, g, unknown or other
  modified_base (335)..(335): a, c, t, g, unknown or other
  modified_base (344)..(344): a, c, t, g, unknown or other
  modified_base (355)..(355): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtctccctgcccgtcacccttggacagccgcctcatctcctgcaggtctagtcaaagtcctacgtatacattgataggaaacnctatagtaatggtcagcagagcaggcaatcncagcactaattatagttcacggatgnggtccagacagctcagcgnaggtgganggcacgtanactcgacatanaaatcgagagagggtggaggtcgtaggaggtagttagggttagggtttaatacgttggactagtgtaacgaaaggtaacacgcgttcgacccgttacgtacgttaccgtttacgggccgaaacggggtccaagtcggttagaacgacttacgaaacttacgtggtcggaactcgacacctcgttcttaacg

SEQ ID NO: 391666 - DNA, 699 bp, Homo sapiens
  misc_feature: GZ8MTXP01CMLXW.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaaggccgtggggcctcgagtgtaaggtctccgtgacaaggtctttcgtaggttaacctaccttttaaccaaacttagttggttatacgtaggtttgggtcgcgacgaccggaccccgtggaacgaacgggtcttaggaggtggtagtgggtatcggatccgaagcgtacttaacgtaacgtggtacaacgaaacctaaactagtacgaccccaacaaccggtaaccctccgaagggaacctaaggaacgtaccaaaccactacgacccaacgacgaacaacacaccgaacgacgaccacggtacctacgaacgttacggaccgtaggacggacgtcctaggggacgtacgtacgtacggacgtaccgaccggtcgttacgttacttacgtgtcggacggaagaggttaacgggtagggttaaatttagtttcgttacgttcggtttccttaaggttacgtaacgtacgggtcgggaccgtaacgggttaaccgtttccg

SEQ ID NO: 391667 - DNA, 802 bp, Homo sapiens
  misc_feature: GZ8MTXP01CMLFV.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcgagtggaaggtctcgtgacaaggtctttcgtaggttaacctaccctttaaccaacttagttaggttatcgtaggtttgggtcggaccgacgacggccccgtaggacgaagggtcttggaggtggagtgggatggatcgagtcgtacttaacgaagtcggtacaactaaactaaaactagtacgaccccaaccgaaacgtaacccgtaccggaacgggaaccgaacgtaacggtacccaaaccgttaacgacccggaaaaccccaacgtaaaccggaacctaacccgtaacgtaccccgaacggaccgtaccgaacccggtacctaacgtacgacggtaccgagggaaccgacgtaccgtaggaacgttacttacgacggaaccggtaaccgtacccggtacgttacgttaacgttcggtacggtcggaaccgggtaaggtaacgggttaacggggtttaaacggggttaaattttaccggttttaacgggaccgtttccggttttaccccgtttaaggttaccggtaaccggttaccggggtacggggttaacccgtaacccgggggttaaccctttaacccggg

SEQ ID NO: 391668 - DNA, 699 bp, Homo sapiens
  misc_feature: GZ8MTXP01DVHNJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctcgtgcaaggtcttctgttacacctttacaactatgtatcgtaggttgggtgcgacgacggccccgtaggacgaagggtcttaggaggtggagtgggatggtatcgaagcgtacgttacgaagttcggacaacgaaaccaaactagtacgacccaacaacgaacccgtcgagggaacaacgtaacgtaccaacctagacgaacccagaacgaacacactaccgaagacgacgaccggacctaacgacgtacgaccgaggaacggacgtcccgtaggggaacgtacgttacgacggaaccgaaccggtcccggtacgttaacggttacttaccggtggtacggacggtaaaggtacggttacgggttaaacggggttaaattttacgtttccggttaaccgtttcggttaccctttggttaccgtaacggtttaccgggcgggttacccgtaacgggttaacccgtttaaccgg

SEQ ID NO: 391669 - DNA, 760 bp, Homo sapiens
  misc_feature: GZ8MTXP01ECTJW.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctgagtgaaggtctcctgcaaggtcttgtgttacacctttacaatatgtatcgaggttgggngcgacgacggcccctggaacaagggtcttaggagtggatggggattggatcgagcgtacgttaacaaagttcggtaccaacaaacctaaaacttgacgacccaacctaaacgtaacccctacccggaaggggtaacccaagtaaccgtaccgaaaccctaaagacccgaaacccgaaacgaacggaaaccaaaccacgtaccccgaaacggaccgaacccggaaccggtaccccttaaacgaaacgttcgggaacccgtaggaaccgggaacgacccgttaggggaagtaacttaccgaacggaacccgtaacccgacgggttacccggttagttaacgttacccgtaggtccgagggaacggaaaggttacgggtaaacggggttaaaatttcggtttacggttaccgttccgggtttaaccctttgtttacggaactttaccggggtaccgggacccgtaaccgggttaacccgttaacccggg

SEQ ID NO: 391670 - DNA, 651 bp, Homo sapiens
  misc_feature: GZ8MTXP01AIDMD.39.81.H04.1.454.CMB.2.raw
  modified_base (289)..(289): a, c, t, g, unknown or other
  modified_base (376)..(376): a, c, t, g, unknown or other
  modified_base (425)..(425): a, c, t, g, unknown or other
  modified_base (550)..(550): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtcgcccactcccaggttcagctggtacagtctggagctgagatgacgaacgccgtgggcctgagtgaaggtctcgtgacgagtcttcgtagttacctaaccctttaaccaacttagtggtactcgtaggttggngcgacgcggcccgtggacgaaggtctggagtggagtgggatggactcgaggccgtacttaacgagttcggacaactaactaaacttnacgacccaacacgaccctacgagggaacaagcgtacactagtacaccanacgaacctacacgaccgaacgacaccggaaccgtcccctaaagacggtaccggacgtaggacggacgtcgtaggggaacgtacctcggacgaaccggacggtccgttacgttagttccgttacgngtacggccggtaagaggttacggttaaaggttacttacggttcgacgtttccgacgttgttacgccgttacgggcgggttaccgaaccggttccgtcccgg

SEQ ID NO: 391671 - DNA, 706 bp, Homo sapiens
  misc_feature: GZ8MTXP01CMMA5.39.81.H04.1.454.CMB.2.raw
  modified_base (226)..(226): a, c, t, g, unknown or other
  modified_base (248)..(248): a, c, t, g, unknown or other
  modified_base (253)..(253): a, c, t, g, unknown or other
  modified_base (261)..(261): a, c, t, g, unknown or other
  modified_base (270)..(270): a, c, t, g, unknown or other
  modified_base (278)..(278): a, c, t, g, unknown or other
  modified_base (285)..(285): a, c, t, g, unknown or other
  modified_base (293)..(293): a, c, t, g, unknown or other
  modified_base (305)..(305): a, c, t, g, unknown or other
  modified_base (324)..(324): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgagccgtgggcctgagtgagtctcngcagcttctgtacacttacatntgtangtagtggngcagcgccngacgaggntgagtgntggatgancgagcgtactanagtcgacacaacgtaaacntacgaccaacgaacgaccgtcgaggggaaccaagaacgtacaaccagtacgaaccacaacgaccactaanacccgacgacgtaccgaaccggtacctaacgagtaccggaaccgttggaaacgggtaccgtaccggttagggaacgttaaaccgttccgggtaacggaaacccggtaaccgggtaacccgggttccgttaaaggttaccgttaaccggtgggtaacggcggaaaggtaacgggttacggttaaacggggttaaattttaacggttttccgggaaccgttttccgggttaaccccttttggttaaccggtaacccggttaacgggggtaccgggttacccgggtaaaccgggttaaccccggtttaacccggg

SEQ ID NO: 391672 - DNA, 700 bp, Homo sapiens
  misc_feature: GZ8MTXP01BME1R.39.81.H04.1.454.CMB.2.raw
  modified_base (278)..(278): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggtcttctgttactaccttacaactatggtatcgtaggttggngcgacacggccccgtaggacgaagggtcgttggaggtggagtgggatggatcgagcgtacttacgaagtcggtacaacaacgtaaactgtacgacccaacgaacgaaccccgtccggaagggacaaacggtcgtacccaaccgaacgttaccgaacccgaacgaacgaaccaacaacgtcccgaacgacgaccgaccggtaccaactagtcggacctagggacgacgccgtagggaacgtagttaccgagaacccgtacgacccggttacgttagtttacgtacgttagggtcgaacggtaaggtaggttacggttaaacggggttaatttaacggtttgttaacccgtttcggttaaccccgtttgttacgtaaccgttacggggtacccgggaccgtaacccgggttaacccgttccggg

SEQ ID NO: 391673 - DNA, 660 bp, Homo sapiens
  misc_feature: GZ8MTXP01D9E5N.39.81.H04.1.454.CMB.2.raw
  modified_base (239)..(239): a, c, t, g, unknown or other
  modified_base (490)..(490): a, c, t, g, unknown or other
  modified_base (550)..(550): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaagtcttntgttacctaccttacaactatgtatctaggttgggtgacgacgacggccccgtaggacgaagggcttaggaggtggagtgggacgtggatcgacgtcgtacttacaagtcggtacaacaactaaactagtcgaccaacgacgtaaccgtacccgaggggaaccaagaacgtacaaacccaggtaccaccaacgacgaaccataccaccgagacgccgaccgtaccctagagttaccgaccgagaagggtcncccgtagggacgtacgtccgagaaccggacgtaccggcgtttagttacgttagtcggcgnggttaagcggttaggttaacgggttaatttaggttcgaacggttcccgttaacccgtttgttacgaacgtttccggggcggggaccgtaacccgggttaaccggttccgg

SEQ ID NO: 391674 - DNA, 672 bp, Homo sapiens
  misc_feature: GZ8MTXP01A9O9T.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttactacctttaccaactatggtatcgtagttgggtgcgacacggcccctggacaagggcttggagtggatgggatggatcgagcgtacttaacaagtcggtacaacgaaccaaaactatcgacccaccgaagaaaccctccgaagggtacagaacgtacaaccagtacgaaccaacgagaaccacgactaccacgacgaccgaccggacctacagtacggaccgtaggaacggtacgcccgtaggggaacgtacgtccgtacggaaccgaacccgacggtaccgttagtaacttaccggtgttacggcgaaggtaacggttaggtaaccggggttaaatttacgtttacggttaccgttcggttaccccttgtttacgaaccgttacggtcggggttacccgtaaccggggttaacccgttaacccggg

SEQ ID NO: 391675 - DNA, 665 bp, Homo sapiens
  misc_feature: GZ8MTXP01EL51C.39.81.H04.1.454.CMB.2.raw
  modified_base (284)..(284): a, c, t, g, unknown or other
  modified_base (588)..(588): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtggaaggtctcctgacgaaggtcttcgtgttacctaacctttaccaatagtgtatcgtaggttggngcgacgacggccccgtaggacgaaggtcttagaggtggagtgggataggacttcgagcgtacttaacgaagttcggaccaaacaaccgtaaactagtacgaacccctaacgaaacgtaacccgtaccggaacgggaacgaacgaacgtacccaaacgactaccgaaacccaacgacgaaacccaacgaccgacccgaacggaccgtaaccgacccggtaccctaaagacggtacggaacccgttagggacgaacgccgtagacgtactaccgacgacgaaccgcgttacgttagtacttacggngacgagtaagacggttaggtaacgttattagttcgacgttccgttctgtacgcgtcggcggacgtaaccgttcgtcg

SEQ ID NO: 391676 - DNA, 613 bp, Homo sapiens
  misc_feature: GZ8MTXP01BJT6U.39.81.H04.1.454.CMB.2.raw
  modified_base (194)..(194): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacncgccgcctccatcctcctgcaggtctagtcaaagcctgtatacattgatggaaacacctattgaatggttcagcagaggccaggccaatccaccgaaggtcgaccttaaatttacgtaaaggttttccaaaccgggtactcgtcggggtacccagacagtacttcagcggcaggtcgggtacaaggctacgtagaacttcacgtaatacgaaatcgaaggtacgaggggtaggacggtacgtaggtagggttagttagggttaggggtttatacgttgacgtataggaccgaaaggactaccgacgtcggaccctccgtaccgtacgtttcggaccggtaacgggaacccttaggccgttaggaacgtaacttacgaaacgttacgtgtacggtcacggtacactaacgttcgttaacg

SEQ ID NO: 391677 - DNA, 690 bp, Homo sapiens
  misc_feature: GZ8MTXP01B46IN.39.81.H04.1.454.CMB.2.raw
  modified_base (210)..(210): a, c, t, g, unknown or other
  modified_base (217)..(217): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagcccgcctccatctcngcgagtntagtacaacgtcctagtatactattagaagtaacgaaacctaccttacgttagtaagtttggtacagacaggacgccgacgacctaatccgaccgaaggccgtaccttaaagtttaacgtaacggtttaccgtaaccggtctcggtacgggacccaagacgtagtactccgagggcgagtacgggtcgggtaacacgggtctaacgtaggtaactaccaacgtaactaaagtaaaactcgtaaggaccgggtaagggggtacgggacggtagtagggtaagggttagtttagggtttagggttactacgtaggactagggtacgaaggaacgtaacacgtcgtcgtacccttacgttaccgttcgttaccggaccggtaaggggaaccctaaggttcggtaagacgtacgtaaaccgaaagttacgttggtcggactaaccggtaacctaacgttcgttcgttcgtttaaccc

SEQ ID NO: 391678 - DNA, 669 bp, Homo sapiens
  misc_feature: GZ8MTXP01EWS67.39.81.H04.1.454.CMB.2.raw
  modified_base (284)..(284): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctaccctttaccaacttatggtatcgtaggttgggngcgacgacggcccctggacaagggtcttggagtggagtgggatggatcgagcgtacttaacaagttcggtacaacaacaaactagtcgacccaacaacgaaccctccggaacggggaaccaagggaacgtaccaaccgtagtacgaaacccacgaaacgaacccaaccgtactacccgaaacgacgaccgaccggtaccctaacgacgtacgggaacctggaacgggaacgtccgtaggggacgtacgtcgtacgaaccgacgaccgggtcctagttactacgtgtacggacgaaggtacgttaagggtaacgggttaaattgtttacgacgttcgttacccttgttacgtaacgtcggcgggacctaacgggttaacccgtcgg

SEQ ID NO: 391679 - DNA, 656 bp, Homo sapiens
  misc_feature: GZ8MTXP01BJTLD.39.81.H04.1.454.CMB.2.raw
  modified_base (567)..(567): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttcgtgttactacctttaaccaacttagtggtatcgtaggttggtagcgacgcggcccctaggacgaaggcttaggagtggagtgggataggatcgagccgtacttaacgaagttcggacaacaaacaaacttagacgacccacgaaacgaacccgtcgagggaccaaggctaccacctagaccgaaccaacgacgaaccaacactacccgaacggacgaccgaaccggacccttaaacgacggttaccgggacctacgggaacggtacgtacccgtaggggtaaacgtcgtacgtacgaaacccggcgtaccggtcgtaagttacgtagnggtcgagaacggagttacggtaaggttattagttgaccgttcgttccgttaattcgcgtcggtcgggaccgtaacggttaacccgtcgg

SEQ ID NO: 391680 - DNA, 678 bp, Homo sapiens
  misc_feature: GZ8MTXP01C4TDI.39.81.H04.1.454.CMB.2.raw
  modified_base (551)..(551): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaacggtctcctgcaaggtcttctaggttacctacctttaaccaactatggtatcgtaggttgggtgcgacgacggcccctagggacgaagggtcttaggaggttggagttgggatggatcgaggctacttacgaagttggacaacacaaaactgtacgaccacaacgaccctacgaggggaacccaggaacgtaccaaccgtacacgaaccacgacgaacaccatacccgacgacgtaccgaacggaccctacgacgtacggactggaaggacgtccgagggtacgatccgtacggaaccgcgacccgggtgttaacgtcgtttaacggnggtacggaggtaacggtaaggttaacgggtaaacgggttaaattttaacgggttcgttaaccgtttccggttaacccttgttacggaaccgttacgggcgggttaaccgtaacgggttaacccgtcg

SEQ ID NO: 391681 - DNA, 700 bp, Homo sapiens
  misc_feature: GZ8MTXP01DPQPP.39.81.H04.1.454.CMB.2.raw
  modified_base (387)..(387): a, c, t, g, unknown or other
  modified_base (582)..(582): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcgtgacaaggtctttcgtcgttaacctaccttttaaccaaacttagtggttatcgtaggttgggtgaccgacgacggcccgtaggacgtaaggtcttggaggtggagtgggataggatcgagtcgtacttaacgaagttcggacaactaactaaacgtntacgacccaacgtaaacgaacccgtcgaacgggtaacaaacgtcgtaccaaaccgtagaccgaaacccaacgtacaaaccactactaccgaacgacgaccgaacggaccttaacgacgttacggaccgtagggaacggtctaccgtaggacgtaacgtcgacgacgaacgccggtacgttagttactcgagtcgnggtaaagtggttaacgggttaaggttaaagtttgtttaacgttacgttcggtttaccccttgtttaaccggaacgttcggggacgggttaccggtaacccgggttaacccgttaacgg

SEQ ID NO: 391682 - DNA, 704 bp, Homo sapiens
  misc_feature: GZ8MTXP01E1BX4.39.81.H04.1.454.CMB.2.raw
  modified_base (293)..(293): a, c, t, g, unknown or other
  modified_base (655)..(655): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatggaacgaagccgtggggcctcgagtggaaggtctcctgcaaggtcttctagttaccacctttaaccaactatggtatcgtaggttgggtgccganacggcccctggaacaaggggtcttggaggtggagtgggatggatcgagcgtactttaacgaagtttcggtacaacaaactaaactacgtcggacccaacgaaacggtaacccctcccggaaagggggaacccgaacgggtaaccggtaccaaacccgtaagtaccccggaaaacccacgtaaacgaaaccctacccgtaaactacccgaaccgggaacgtacccgaaccgggtaccctaacgttacggaccggtaacgacggacgggtacgaccgtagggaacggtactacgtacgaccgacggtaccggtcgttattacgtactggcaggaagtcgttagggtaacggttaaattggttanacgttcgttaccttgtagtcacgggtccgggacgtaaccggttcgtccg

SEQ ID NO: 391683 - DNA, 722 bp, Homo sapiens
  misc_feature: GZ8MTXP01CG5JY.39.81.H04.1.454.CMB.2.raw
  modified_base (616)..(616): a, c, t, g, unknown or other
  modified_base (620)..(620): a, c, t, g, unknown or other
  modified_base (678)..(678): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagcgtgggctcgagtgagtctcgtgactaggtcttcgtagttacctacctttacaactagtggtatcgtaggttgggtgcgacgcggcccgtaggaacgaagggtcttaggaggtagggagtaggggtacgtaggtactcggtaacggtccgttaacgtttaaacgtaaaggtttcggtaaaccaaaccgtaaaccgtaaaacttacgtacggaaacccccaaaccggtaaaccgtaaaccccgtaccggaacggggaaccgtaaacgtaaccggtacccaaaccgtaactaccggaaaccccaagtaacgaaccactaccgaccgaacgacaccgacgactacgagtacgaccgtagacgacgacgtagggacgtacgtcgtacgaccgtacgaccggttgttagtattacggngtgnggtaagaggttacggttaacgggttaaatttcggttacgttaccgttcgttacctttnttaacgaacgttcgggaccgggacgtaaccgggttccgtaaccg

SEQ ID NO: 391684 - DNA, 640 bp, Homo sapiens
  misc_feature: GZ8MTXP01DY1V9.39.81.H04.1.454.CMB.2.raw
  modified_base (377)..(377): a, c, t, g, unknown or other
  modified_base (389)..(389): a, c, t, g, unknown or other
  modified_base (415)..(415): a, c, t, g, unknown or other
  modified_base (435)..(435): a, c, t, g, unknown or other
  modified_base (460)..(460): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcgagtggaaggtcctcctgactaaggtcttcgtgttacctacctttaaccaattagtggtatcgtaggttgggtgcgacgacggcccctaggaacgaagggtctgaggtggagtgggatggatcgagcgtattacgaagttggtacaacgaactaaacgtntcgaccaacganaacccgtcgaggacaagcgtcaaacntacgaaccatacgacactancccaaggacacgacccgtaccttanagtccggacgaggagacgtcaggggaatcgtcgagaccgacgacgtcgtagtatacgtgtcgacggaagagttagggttaacggttaaatttacgtttacggttacgttcggttacccgtttaagtttaacgaaccgtttccgggtacgggacccgtaaccgggttaaccgtttcccggg

SEQ ID NO: 391685 - DNA, 739 bp, Homo sapiens
  misc_feature: GZ8MTXP01BKD7G.39.81.H04.1.454.CMB.2.raw
  modified_base (190)..(190): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtctgganctgagatgacgagcgtgggctcgagtgaggtctcgtgacaggtcttcgtgttacctaccttaacctaattagtaggttactcgtagggtttgggcgacgacgacggccccgtaggacgaagggtcttggaggtggagtgggaatggattcgacgtacgtacttaacgtaagttcggtaaccaaactaaacctaaactagtacggaaccccaaacgaaaccggtaacccgtaccggaacgggggaacaaggtaacgtacccaaacccgtaagtaccgaacccaacggaaaccgttaaaccaaccactaccccgaacggtacacccgtaccggaccttaaacgcgtacggaccgtaggacggaactccgaggtacgtacgttagaccggacgaaccgccggttcgttaagttaagttccgagggtcgaagggtaagtaaggttagggttaaacggttaagttttacgtttaacgttaccggtttcgttaccccgtttaagttaccgaacgttaccggggtacggacccggtaaccgggttaacccgttcgg

SEQ ID NO: 391686 - DNA, 716 bp, Homo sapiens
  misc_feature: GZ8MTXP01EKOAU.39.81.H04.1.454.CMB.2.raw
  modified_base (261)..(261): a, c, t, g, unknown or other
  modified_base (276)..(276): a, c, t, g, unknown or other
  modified_base (281)..(281): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcgagtgaaggtctcgtgcaaggtcttctgttacacctttacaactntggtatcgagttggncgacncggcccgtggacgaaggcttggaggtgagtgggatggactcgacgacgtacttacgaaagttcggtaaccaaccgaaacgtaaaactagtacgaaccccgtaacgtaaaccggaacccgtaccgaacgggggtaacaaacgtaacggtaccaaacccgagtaccgaaacccgacgaaacgaacctacgaactaccgacggtaacgccgaaccggtaccctaacgtaagtcgggaacctgggaaggtaccgaccgtaggggaaagttctacgtccggaaaccggacccgtcgggtcgttaacgtttaacgtcgtacggtccggaaggttaaggacggttaagggttaacgggttaaattacgtttagaaccgtttcgttacccgtttgtttacgaacgtttcgggacggggttaccgtaaccgggttaacgtccgg

SEQ ID NO: 391687 - DNA, 683 bp, Homo sapiens
  misc_feature: GZ8MTXP01AGT64.39.81.H04.1.454.CMB.2.raw
  modified_base (262)..(262): a, c, t, g, unknown or other
  modified_base (343)..(343): a, c, t, g, unknown or other
  modified_base (565)..(565): a, c, t, g, unknown or other
tcagtcgcactagtcacgaccggtgctcgatttagtagtgtagattcgcggggcacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgagccgtggggcctcgagtgaaggtctctgcaggtcttcgtggttacacctttacaactntgtatcgaggttggtgcgacgcggtcccctagggacgaagggtctgaggtggagtggggagtggactcaggtcgtactaanagttacggtacaacgaactaaactatcgacaacgacgaaccctcggaaaggccaaggcgtacacgagtccgaacacaaacgacacgactacccgaacggacgaccgtaccggaccttaccgacggttaccggaccgtaggaacgggacgtaccgggtagtaacgtacgttacgaaccgaccggtacgacccgggtacgttacgtacgtttacgtggtacggnggtaaggttaggtaacgggttagggttaaaactttgtttacggttacgttacccgggtttaacttgttaaccggtaacgttacggggttcggggtaacccgaacgggtttaaccccgg

SEQ ID NO: 391688 - DNA, 709 bp, Homo sapiens
  misc_feature: GZ8MTXP01CSID2.39.81.H04.1.454.CMB.2.raw
  modified_base (385)..(385): a, c, t, g, unknown or other
  modified_base (500)..(500): a, c, t, g, unknown or other
  modified_base (522)..(522): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtgaaggtcctccgtgcgaaggtcttcgtgttaacctacctttaaccaattatggtatcgtaggttgggtcgcgacacggccccgtggaacgaagggtcttaggaggtggagtggggagtggatcgagtcgtacttaacgaagttggtaccaacgaaactaaacttntacgaccctacaaacgaacccgtcggaacggtaacgaagtaacgtaccaaaccgacgtacgaacccaacgaacgaacaacgtacacccgaaggaccgacgacccggtctaaacgnggtacgaccgtgaacgggtacnccgttaggggaactacggttccaacgggaacccgtaccggtacgggtcccgttaaagttcttaccggaggtacgcggaaaggaacgttaaagggtacggttaaagtttcgtttacggacgtttcgttaccctttaagtagtaaccggtacgggtaccggttaccgtaaccgggttaacccttccggg

SEQ ID NO: 391689 - DNA, 608 bp, Homo sapiens
  misc_feature: GZ8MTXP01BQLSN.39.81.H04.1.454.CMB.2.raw
  modified_base (255)..(255): a, c, t, g, unknown or other
  modified_base (275)..(275): a, c, t, g, unknown or other
  modified_base (286)..(286): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccgttggacagcccggcctccatctcctgcaggtctagtacaaagcctcgtatacattgatgaaacnctattgattggttcagcagngccagccatcncagcactaattatagtttcaacggctcgtgggtccagacacgattcgagcggctaaggtcgggtcagggccagttagaacttccaacaactagaaaatcgaaggtcgaaggggtggaacgggcgttagggagggttagttgggtttaggggtttaattaccgtggggactagttacgacgtaaaggaccacgtacgtacggcccttaccgtacttacggtttcgggaaccgtaacgggggaaccagggccgtagggtaacgaacgttacgaaaacggtaacttgggtaacggtccgtacgaccgtaacccgttaagttcccg

SEQ ID NO: 391690 - DNA, 792 bp, Homo sapiens
  misc_feature: GZ8MTXP01C8OAL.39.81.H04.1.454.CMB.2.raw
  modified_base (625)..(625): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagccgtggggcctcagtgaaggtctctgcaaggtcttctgttacacctttacaactatgtatcgtagttggtgcgacgacggcccctggacgaagggtcttaggaggtggagtggggatggatcgagtcgtacttaacgaagtttacggaccaaactaactaaaactagtacggacccccaaacgaacgtaacccgtaccgaacggggaacccgaaggaaccgttacccgaaacccctaagtacccggaaacccaactaacgggtaacccactaactaccccgaaacggtaccgaccgaacccgggtaacctaacgtaacggtccgggtaaccctaggggaaacggaacgtcccgttaaaggggaaggtccttaccgggtacggaaacggtacccgaccgggttaccgttaagttacttaccggnggtaaacgcgggtaaacggaagggttaaacgggttacgggggttaaaacttttaacggtttcggttaaaccccggttcgggtttaccccctttaagggttttaacgaaccggttttaacgggggccgggggttaccccttaaccgggggttaacccctttcccgggg

SEQ ID NO: 391691 - DNA, 672 bp, Homo sapiens
  misc_feature: GZ8MTXP01EFZ9R.39.81.H04.1.454.CMB.2.raw
  modified_base (261)..(261): a, c, t, g, unknown or other
  modified_base (280)..(280): a, c, t, g, unknown or other
  modified_base (577)..(577): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtgttactacctttaccaactntggtatcgtaggttgggtncgacacggcccctaggacaagggcttggagtggagtgggatggatcgagcgtacttacaagtggtacaacgaacaaactagtcgacccaaccgaacgtaaccctcccgaaggggaaccaaggaacgtaccaacccaagtaccgaacccaacgaacgaacctacaacgtaccccaaggaacgtccgaaccggacccttaaacgacgttacgggaacccttgggaacggacgcccgttaggggaacgtacgttccgtaacggaccgaacggtaccggtaccgttagttatacgtgacgnggaagaaggttgtaacgggttaaatttgttacgacgttcgttaccttcgttacgaacgtttcgggcgggttacgtaaccgggttaacccgttcgg

SEQ ID NO: 391692 - DNA, 812 bp, Homo sapiens
  misc_feature: GZ8MTXP01AUKER.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaagtctctgacgagtcttcgtcgttactaccttacactatgtatcgtaggttggtgacgacgacggcccgtggacgaggtctggaggtggagtgggagtaggatcgagcgtacttacgagtggtacaacgtaactaaatacgtacgaaccaacgacgtaacccgtacgacggtaacaacgtaacgtaccaaccgtataccgaaccacgaacgaaccaacctacgtaccgaacggacgacccgaaccggtaccctacgagttacccgggaacgacggaacggtacgtacccgtaggggaacgtacgtttacccggaacggtaaacccgggtacccggacccggttaccggtttaaggttaacgtttaccggttaaggggtacccgaacggggttaaaaggtaacggggttaaacggggttaaaaccggggttttaaagttttccgggttttaaacgttaaccccggggttttacccgggttttaaccccccgttttaaggttttaacccgggtaacccggtttttaaaccccggggggccccgggggttaaaccgtttaaacccccgggggttaaccccgttttaaccccgggg

SEQ ID NO: 391693 - DNA, 637 bp, Homo sapiens
  misc_feature: GZ8MTXP01BE7OX.39.81.H04.1.454.CMB.2.raw
  modified_base (238)..(238): a, c, t, g, unknown or other
  modified_base (255)..(255): a, c, t, g, unknown or other
  modified_base (260)..(260): a, c, t, g, unknown or other
  modified_base (329)..(329): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtcgtggagctgagatgacgagcgtgggctcgagtggaagtctctgacagtcttntgttactaccttacatntgtangtaggtggtgcgacgcggcccgtggacgaaggtctggaggtggagtgggatggatcgagcgtacttaanagtcgacacaacaaactgacgaccaacacgaacctcgaagggaacacgcgtacaacacgtcgaaccacaacgacaacacaccgaacgcaccgaccgtacctacgacgtacggaacctgggacgaacgtcgagggacgtacgttccgacggaaccgtaccgtacggtccgttattacgttacggtgtacggcggtaaaggagttagggtaaacggtttaaagtttcggttacgttaccggtttccgttaccgttcggttacggaacgttccggggaccggttaccggtaaccggttaacccggttccgg

SEQ ID NO: 391694 - DNA, 597 bp, Homo sapiens
  misc_feature: GZ8MTXP01DV6O2.39.81.H04.1.454.CMB.2.raw
  modified_base (404)..(404): a, c, t, g, unknown or other
  modified_base (590)..(590): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgccccgtcacccttggacagcccggcctccatctcctgcaggtctagtcaaagcctagtatacattgataggaaactcctattgaattggttcagcagagccaggccaaatctaccgaaggctaccttaaatttagtaaggtttcctaaaccgggacttccgtcgggggtacccagaccagacttcgaggcggcaagggtgggtcagggctaactgaacttcaanactagaaatcgagcgagggtaggaggacgtaggaggtagttggttaggggtttattacgtgggtactagtgaacgaaaggaacacgacgtacggcctaccgtactacgtttcgggaaccgaacggggttacaaggcgtagggacgagttacgaaacgtaacgtagtcggtctacggacctaaccgnttaaccg

SEQ ID NO: 391695 - DNA, 630 bp, Homo sapiens
  misc_feature: GZ8MTXP01AGQW8.39.81.H04.1.454.CMB.2.raw
  modified_base (289)..(289): a, c, t, g, unknown or other
  modified_base (368)..(368): a, c, t, g, unknown or other
  modified_base (420)..(420): a, c, t, g, unknown or other
  modified_base (454)..(454): a, c, t, g, unknown or other
  modified_base (524)..(524): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttaaacttggtggcagcaacaacaggtgcccactcccaggttcagctggtacagtctggagctgagatgacgaagccgtggggcctgagtgaaggtctcctgacaaggtcttcgtggttaacctacctttaacaactatggtatcgaggttgggtcncgacacggcccctaggacaagggtcttagagtggatgggatggatgagccgtattaacaagtgtacaactaacaaactntcgaccaacacgaaccctccgaaagggaccaaggacaccaacagtacaacanaacgacatacaccgagacgctaaccggacctaanacgtacggacgtaggagacgcggtagacgtactacgacgacgacgacggtacgtacgttagttacgtcgnggaaggagaaggtaacggttaacggttaaagtttaacgttacgttacgttaccgttaaccttacgttaacgtacgtacggttaccgggtaaccggaacggtaaccg

SEQ ID NO: 391696 - DNA, 684 bp, Homo sapiens
  misc_feature: GZ8MTXP01B4D9Y.39.81.H04.1.454.CMB.2.raw
  modified_base (264)..(264): a, c, t, g, unknown or other
  modified_base (269)..(269): a, c, t, g, unknown or other
  modified_base (279)..(279): a, c, t, g, unknown or other
  modified_base (284)..(284): a, c, t, g, unknown or other
  modified_base (308)..(308): a, c, t, g, unknown or other
  modified_base (486)..(486): a, c, t, g, unknown or other
  modified_base (500)..(500): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctgagtgaacggtctcctgacaaggtcttcgtagttactacctttacaatntgtancgtagtcggncgacncggccctgacaggctgaggtgagnggatgatcgagctacttacgaagtcgtacacgaacaaactatcgaccaacaacggaaccctacggacgggaacaacggaactaccaaacccgtgaaccgaaacccaacgaaactaaaccaaccaactacccgaaacggacgaccgttaacccgggaccttaaccgaagtccgggaacngggaacgggtaacnccggttaaggaaggtattaccgaacgggaccgtaaccgaccggtacgtacggttacttaccggaggtacgacggaaggtagttaaccgggttaaagggttaaatttacggttaacgttacgttcgttacccgtctttaggaacgttccggacgggttaccgtaacgggttaacccgtaaccggg

SEQ ID NO: 391697 - DNA, 732 bp, Homo sapiens
  misc_feature: GZ8MTXP01DAXF5.39.81.H04.1.454.CMB.2.raw
  modified_base (214)..(214): a, c, t, g, unknown or other
  modified_base (272)..(272): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgccactcccaggttcagctggtacagtctggagctgagatgacgaagcgtggggcctnagtgagtctctgcgaaggcttctgttactacctttacactatggtatcgtaggttggngcgacgacggcccctggacgaagggtcttaggagtggagtgggatggatcgagcgtacttacgaagttggtacaactaactaaactatcgacccctaacgaaacgtaaccctaccggaaggggacctaagggaacgttacccaaacctaacgtaccgggaaaccccaacgaacgaaccctaccacgtaccccgaacgggacgtaccgaacccgggtacctaacgacggttaccgggaaccgtagggacggaacgtcccgtaaggggaacgtacgttacgacggaaccgaaccgtaccgggtacgtttagttaacgttacggtgacgggaacggtaaaggagttaaacggggttaaacgggttaaagttttacggtttcggaacccggttttcgttacccgtttaacgttacgtaacgttaccgggtacggggttacccgtaacgggttaacccgttccgg

SEQ ID NO: 391698 - DNA, 709 bp, Homo sapiens
  misc_feature: GZ8MTXP01A6286.39.81.H04.1.454.CMB.2.raw
  modified_base (575)..(575): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaacggtctcctgcaggtcttcgtgttacctaccttaccaactatggtatcgaggttgggtgcgacgcggcccctggacgaagggtctaggaggtggagtgggatggatcgagcgtacttaacgaagttcggtacaaccgtaactaaacgtatcgaccccaacgtaacgaacccgtacgacggggtaacaacggtaacgtaccaaccgacgtaccgaaccacgaacgaaccactagacccaaacggacgccgaacgtccctaagacggtaccggaacgtacggaacggacgtccgtaggggacgttacgtaccgagggtaacccggacgtaccggtcggtttaacgtactttacggngtacgggaccggaagggtacggttaacgggttaaacgggttaaagttttaccggtttacggaacgtttccgttaacccgtttgttacggccggttacgggtaccggggacccgtaaaccgggttccgtaacggg

SEQ ID NO: 391699 - DNA, 696 bp, Homo sapiens
  misc_feature: GZ8MTXP01BRXS0.39.81.H04.1.454.CMB.2.raw
  modified_base (259)..(259): a, c, t, g, unknown or other
  modified_base (572)..(572): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtcgtggagctgagatgacgaagccgtgggcctcgagtgagtctcgtgcagtcttctgttacaccttacatatgtancgtaggttggtgcgacgacgccccgtaggacgaagggtcttaggaggtggagtgggtagtggatcgaaggcgtacttaacgaagttcggtacaaactaacaaactgtacgaccctacgaaacgtaaccctcgaagggactaaggcggtaccaaccgtataccgaaccaacgaacgaccaacacgtaccaacggaccgaccgacccggtaacctaacgtacgtcggggaaccctaggaaccggacgtaccgttaggggaacgtacgtccgtaacggaaaccgaccggaccggttccggtaaagtcgtttaccgnggttacgcggaaagtaggttagggttaaaggttaaagtttcgttaacggaccgttccggttaaccgtttgttacggtaacgttaacggggtcggggacccgtaaccggttaaccccggttccgg

SEQ ID NO: 391700 - DNA, 647 bp, Homo sapiens
  misc_feature: GZ8MTXP01BOCLH.39.81.H04.1.454.CMB.2.raw
  modified_base (212)..(212): a, c, t, g, unknown or other
  modified_base (234)..(234): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcgtgggcctnagtgagtctctgcaaggtcttntgtactaccttacaatatgtatcgtagttggtgcgacgacggccctaggacgaaggtcttggaggtggagtgggatggatcgacgcgtacttacgaaagttggtacaaacctaaactaaaacttagtaccgacctaaccgaaacgtaaacccgcggaagggaaccaaggtaacgtaccaacccaagtccgaaaccaacgaagacctactacacccgacgacgaccaacggtacctacgagtcggaccgaggaacggacgtccgtaggggaagtacttacgacggaaccgacgtaccggtacgtacgttatacgtggtacgcgggaagaaggacggtagggttaaatttgtttcggacgttcggttacccttgttacgaacgttcggacgggaccgtaacgggttaacccgtgg

SEQ ID NO: 391701 - DNA, 598 bp, Homo sapiens
  misc_feature: GZ8MTXP01D3F78.39.81.H04.1.454.CMB.2.raw
  modified_base (358)..(358): a, c, t, g, unknown or other
  modified_base (400)..(400): a, c, t, g, unknown or other
  modified_base (411)..(411): a, c, t, g, unknown or other
  modified_base (505)..(505): a, c, t, g, unknown or other
  modified_base (512)..(512): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcattccttttcttggtggcagcaacaacaggtgcccactcccaggttcagctggtacagtctggagctgagatggacgaagccgtgggcctgagtgagtctctgactaagtcttgtgttactacctttaacaactagtgtatcgtaggttggcgcgacacggccccgtaggaacagggtcttaggagtggagtgggatggatcgagcgtacttacagtcgacaacaacaaatntacgacacgaacgtacctacggaaggacaaggctacacgtanccgaacacganacactacacgacgagacgaccgtactacagtcgacgtaggaggacgacgtagactactacgacgacgacgtacgtaccgttattactacggtgnggaacgngttaggtacggttaaaggtaatttcgttacgttcgttacgtccgttgttaaccgtacggtcgggacggtccggttaacggttcccg

SEQ ID NO: 391702 - DNA, 654 bp, Homo sapiens
  misc_feature: GZ8MTXP01EPQP2.39.81.H04.1.454.CMB.2.raw
  modified_base (290)..(290): a, c, t, g, unknown or other
  modified_base (432)..(432): a, c, t, g, unknown or other
  modified_base (488)..(488): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgacaaggtcttacgtggttaccacctttaccaatatggtatcgaggttgggtcacgacgngcccctggaaccaagggtcttggaggtggagtgggatggatcgaaggcgtactttaacgagttcggtaccacgaaactaaactgtcgaccacgaagacctccgaggtaaccagcgtccacatacgaaccacagtaccacacnccacgagcctacggacctagatcggacgtagacggacgtacctggaacgcgttacnggaacacccggacggtaccgttagaagtttccggtaggtacggacgtaaaggtagggttaaacggtaaccggggttaaatttaccggtttaagaacccgttcgggttaaccccttggttaccgaacgttaacggtcggggacctaaccgggggttcccttaaccgg

SEQ ID NO: 391703 - DNA, 724 bp, Homo sapiens
  misc_feature: GZ8MTXP01AC99K.39.81.H04.1.454.CMB.2.raw
  modified_base (442)..(442): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcgagtgaacggtctccgtgacaaggtcttcgtgttactacctttaccaacttatggtatcgtaggttgggtgacgacgaccggtccccgtaggaacgtaagggtcttaggaggttaggagtgggacgtggatcaggcgtacttaacgagtcggaccaacaactaaacgtatacggaaccaaccgaacgtaaccccgtacgagggtaaacaacggcgtcccaaacgtnaccgaacccagaacgacaccaactaccgaacgacgtacccaaggaccctaagcgtaccggtaccgaggacgacgtaccgaggaacgcttacggacggaccgtaccgacgggtctttaggtaactttccggaggtccggaggtaaagtgggttaaacgggttaacggggttaaacttttcgtttaacgggttaccggtttccgtttaaaccccggttgtttaacggaaccgtttaccgggcgggggttaacccctaacgggggttaaccccgtttaaccgggg

SEQ ID NO: 391704 - DNA, 857 bp, Homo sapiens
  misc_feature: GZ8MTXP01BFE5V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcgtgcagcttctgtactaccttacactatgtatcgtaggttggtgcgacgacggccccgtagggacgaagggtcttaggacggtagagtaggggactagggactcgaacgtcgtacgtttaacgaagttcggtaccaaccaaactaaaacgtactacggaccctaaccggaacgaaacccgtacccggaacgggaacccgaacggtaacgttacccgaaacccgtacgttaaccggaaccccaaacgtaacgggaaacccaaccgtaaacgttaccccggaaacggtaccggaccccgtaaccgggtaccccgtaaaccgtagggttaacccggggaccgttacgggaacggggaaccgtaccccgggttaaggaacggtaccgttacgtaccgggaaacccgaacccgggtacccggggttaccggttagttaaacgttttcccggtagttacggggaacggtaaacggggttaaggttaaaggggtaaacccgggttttaaagtttaacggttttaccggttaaccggttttcccgggtttaaaccccgttttcgtttaaaccgggtaaccggttaacggggtaccccggggttaaccggtaacccggggttaaccccgtttaacccggg

SEQ ID NO: 391705 - DNA, 785 bp, Homo sapiens
  misc_feature: GZ8MTXP01A3BU3.39.81.H04.1.454.CMB.2.raw
  modified_base (215)..(215): a, c, t, g, unknown or other
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgagccgtgggcctnagtagagtctcgtgcagtcttctgttactaccttacatatggtatcgtaggttggngcgacgacggcccctaggaacgtaagggtcttaggaggtggagtgggatggatcgacgtcgtacgtttaacgaagttcggtaacaaccgtaaactaaacgtagtaccgaacccgtaaccgaaacgtaacccgtacccgaggggaaacccaagggtaaccgtaccaaacccgtaacgtaaccgaacccaaacgaacgaaccctaaaccgtacgtaccccgaaacggaccgacccgaaccggtaccctaaacgtgtaccggggtaccgtagggacggacgtaccgttaggggaacgttacgtccgtaacggaacccggacccgtaccgggttaccgttaggtttaacgtacgttgggtacgggaacggaaggtaaacgttaaggggttaaacgggttaaattttccggtttaacggacccgtttccgggttaacccccgtttggtttaaccggtaaccccggttaggggggtacccggggttaaccgggtaaccccgggtttaacccgtcccgggg

SEQ ID NO: 391706 - DNA, 816 bp, Homo sapiens
  misc_feature: GZ8MTXP01BRM59.39.81.H04.1.454.CMB.2.raw
  modified_base (263)..(263): a, c, t, g, unknown or other
  modified_base (279)..(279): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatagacgaagccgtggggcctcgagtgaaggtctctgcaaggtcttcgtgttactaccttacaactntgtatcgtaggttggngcgacgcggcccgtggacgaaggtcgttaggagtgggagtgggagtggatcgagcgtacgttacagttaggtaccacaactaaacgtatacgacaccgaacgaccctacggaggaaccacggaacgtaccaaccgtacgaccgaaccaacgacgaaacccacgtaacctacccggaacgacgaaccccgtaccgggtaaccccttaaacgcggttaccgggaaacccgaggggaacccggaacgtacccgttaaggggaacgttaaccggttaccgaacgggaacccggtaacccgggtacccgggtttacgtttaacgttaacgtttacggtgggtaaccggaggggtaaaaggtaaggttaaacgggggttaacggggtttaaaaaccttttttacggggtttacccgttaaacccgggtttttccggttttaaaccccgttttcgggtttaaaccgggtaacccgtttacccggggggttacccggggggaacccgtttaaaccccggggggttaaacccgtttttccccgggg

SEQ ID NO: 391707 - DNA, 725 bp, Homo sapiens
  misc_feature: GZ8MTXP01A5OG5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgacgaaggtcttcgttaggttacctaaccctttaaccaacttagtcggttatcgtaggttgggtgcgacgcggcccctggacgaaggcttggaggtggagtgggatgggatcgaagtcgtacttacgaagttcggtacaaacctaaactaaaactacgtacgaccccgaacgaacgaaacccgtaccggacgggaaccaacgggtaacgacctaacccgagttaccaaccgaacgaacgaaccaacgactacccgaacgacgaccgaaccgggtaccctaaacgacgtaccgggaaccgaggaacgggacgtcccgaggaacgtactccggagaacccggaacgtaccgggtacgttacgttgttaaccgtgtccgtaggaacgtagggttaacgggtaacggttaaagttacgtttacgaccggtttccgtttaccgtcgtttacggtaaccgtacgggtccggggacccgtaacgggttaacccgttccggg

SEQ ID NO: 391708 - DNA, 599 bp, Homo sapiens
  misc_feature: GZ8MTXP01ETJMW.39.81.H04.1.454.CMB.2.raw
  modified_base (190)..(190): a, c, t, g, unknown or other
  modified_base (233)..(233): a, c, t, g, unknown or other
  modified_base (263)..(263): a, c, t, g, unknown or other
  modified_base (383)..(383): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatgacgagcgtgggcctcagtgagtctctgcagtcttntgtactacttacatagtgtatcgagttggngcgacgcggccctggacgaagggtctaggaggtggagtgggatggatcgagctacttaagagtggtacaacaactaactgcgaccacacgaaccgtcgaacggacagaagtccaacctancgaaccacganaccacacacgacgtcgacgaccgacctagagtacggacgtggacggacgtccgtaaggacgtacgtcgacggacgtaccgacggttccgttagttacgtacgtgtcgaaggtaaggtaagttagggtaaacgttagtttacgttgaccggttcgttacccgttgtacggtaaccgttgggcggggacctaacggttaacccgtcg

SEQ ID NO: 391709 - DNA, 575 bp, Homo sapiens
  misc_feature: GZ8MTXP01BLJ31.39.81.H04.1.454.CMB.2.raw
  modified_base (401)..(401): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcaccttggacagccgctccatctcctgcagtctagtacaaagcctgtatacattgatagaaacaccttattgaattggtcagcagagccaggccaatctaccaaggctaccttaaatttagtaaggtttcgaaccggactcgtcgggtccagacagtactcaggcggcaggtcggtacaggcacgtgaacttcacactagaaactcagcgagggtgacgngtaggagtagttggttacgggttatacgtgcgagtagaagaacggaactacgaccgtgtaccgtaccgtataccggtttacggaccgtaagggaaccgaagcgtagggacgtaaacgtaacgaaaacgcgttaggtaacgcgtcggacctacttacgttccgttcgtttaaccc

SEQ ID NO: 391710 - DNA, 805 bp, Homo sapiens
  misc_feature: GZ8MTXP01EQZ9H.39.81.H04.1.454.CMB.2.raw
tcagtcgcactagtcacgaccggtgctcgatttagtagtgtagattcgcgggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacggcccggcctccatcctcctgctaggttctagtacaaagtcctgtatacattgataggaaacacctattgaattggttcagcaggacggcccaggacccaaatcctaccgaaggtccgtaacctttaaatttagttaacggtttacctaaacccggggtcttccgttacgggggtaccccaaggtacctagtaactttccgaaggtccggaccgtaaagggtttccggggaacacggggtacctaaacgtttacgggtaaaccttttaccaaaccgttaacgttaagtaaaaaacgttcccgtaaagggtaccgggaaacgggggttacgggtaagggtaccggtttaaggggaaagggtttacgggtttaggggttttaagggggttttaaacttaaccgggttaggggtaccgtaaaggttaaccggaaccggttaaaacggtaacccgaacgaacccggttccggtacccgtttaacccggttaccttaccggggtttacggaacccggtaacggggttaacccgaaacgggttccgttaagggaacgttaaacgttaaccgaaacgtaaccgtggtaacgactcggactaacttaacggttccg

SEQ ID NO: 391711 - DNA, 726 bp, Homo sapiens
  misc_feature: GZ8MTXP01B0WPX.39.81.H04.1.454.CMB.2.raw
  modified_base (189)..(189): a, c, t, g, unknown or other
  modified_base (215)..(215): a, c, t, g, unknown or other
  modified_base (230)..(230): a, c, t, g, unknown or other
  modified_base (237)..(237): a, c, t, g, unknown or other
  modified_base (253)..(253): a, c, t, g, unknown or other
  modified_base (265)..(265): a, c, t, g, unknown or other
  modified_base (270)..(270): a, c, t, g, unknown or other
  modified_base (319)..(319): a, c, t, g, unknown or other
  modified_base (337)..(337): a, c, t, g, unknown or other
  modified_base (347)..(347): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctnagtgaaggtctctgnaggcttntgttacaccttacatntgtatcagtggncgacncggccctggacgaaggtcttgagtggatgggatggatcgagcgtctaanagtggacacaactaaatntgaccccaanaacgaacctccgagggaaccaagcgtaccaacgatacgaacccaacacgacccaacacgtacccaacggacgaccaacccggtaccctacgtaacgtacggacctaggaacgggacgtacccgtaggggaaacgtacgttccgtaaacggaacccggaaccgtacccggggtaccgtttaaggtttaaacgtttacccgttaaggggtcccggtaacgggaaggggtaaacggttaaaccggggttaaacgggggttaaaatttttaacgggttttacgttaacggtttcccggggtttaaaccccttcgtttttacccggaaccggttacggggttaccgggggaccccgtaacgggggttaaacccccgttccgggg

SEQ ID NO: 391712 - DNA, 744 bp, Homo sapiens
  misc_feature: GZ8MTXP01EI4VW.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaaacaggtgcccactcccaggttcagctggtacagtctggagctgagatgacgaagccgtggggcctcagtgaaggtctcctgcaaggtcttctgttacacctttaccaactatggtatcgtaggttggtgcgacgacggcccctaggacgaagggcttggaggtggagtgggatggatcgagcgtacttaacgaagtggtaccaacaactaaaactagtacgacccaacgaacgtaacccgtacgagggaacaagaacgtaccaaacctacgtacgaaacccaacgaacgtaaaccaactactaacccgaacggacgaccgaaccgggtacctaacgtaacgtaccggaaccgtagggaacggtaacgtcccgtaagggaacgtacttaccgaacggaaacccgtaaccggtacccgggtaccgtttaaggttaacctttacggtacggtacggacgggtaaaggtaaacggttaacgggttaaacggggttaaaatttcggttttaacgaccggtttaccgggttacccctttaaggtttacgaaccggtttacgggaccggggttacccgtaacgggttaaccccgttccggg

SEQ ID NO: 391713 - DNA, 769 bp, Homo sapiens
  misc_feature: GZ8MTXP01EN5WY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtaggttacctacctttaaccaacttagtaggtatcgtaggttgggtcgacgtacgacggtcccccgtagggaacgtaagggtcgttaggaggtgggaagtggggatgggatcgaaggccgtacgtttaacgtaagttcgggtaaccaaacgtaaacctaaaacttatcgaaccccgaaaccgtaacgaaccccgtacgaacggggtaaccaaggtaacggtacccaaacccgtaagtaccgaaacccaacgaacgtaaaccaactaactacccgaacggacgacccgaaccggtaccctaaacgagtaccgggaactacgggaaacggaacgtcccgtaggggacgtacgttccgacgaaccggtaacgaccggtacggttagttacgttacggtagtcggacggaaggtaaggacggttaaacggggttaaaatttcggttttacgttaccggtttccgggttaccctttgtttacggtaaccgtaacggggttccggggaccgttaaccggggttaacccgttcgg

SEQ ID NO: 391714 - DNA, 695 bp, Homo sapiens
  misc_feature: GZ8MTXP01BVFN4.39.81.H04.1.454.CMB.2.raw
  modified_base (277)..(277): a, c, t, g, unknown or other
  modified_base (352)..(352): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcaggtgaaggtctcctgcaaggtcttctggttaccacctttaccaactatggtatcagttgggngacgacacggccctggacaaggcttgagtgatgggatggatgagcgacttacaagtcggtacacgaacaaaactntacggaccaccagaaccctcgaggggtacaacggcgtacaacccgtaatcgaacccaacgagaccaactaactacccgaaggaacgccgaaacggaccccttaagacgttacgggaacccgttaggagggacgtacccgttggggaaacgtacgttaccgacgtaaccgggaaacccgtacccggggtccgttagggtaacttttaccggaggttggacgtaaagggtcgggttaaagtagggggttaaaacctttggtttacgttaaccgttccgggttaccccttgttacggtaacgtacgggtacggggaccccgtaacgggggttaaccccttaacggg

SEQ ID NO: 391715 - DNA, 719 bp, Homo sapiens
  misc_feature: GZ8MTXP01B52ZC.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaagcttctgttacacctttaccaactatggtatcgtaggttgggtgcgacgcggaccccgtaggacgaagggtcttggaggttggagtgggagtaggatcgaacggcgtacttaacgaagttcggtacaaaccgaaacctaaactagtacgaccccaacgaaacgacccgtacgaacgggaccaagcgtacaacctagtacgaaccacgaaacgtaacactacgacccgaacgacgacccgaaccggaccctaacgtacgtacggaaccgttagggaacggtacgaccgttagggaacgttaacgtccgacggaacccgacgacccggtacgttacgttacgttaaccgttgacggacggtaaggaaggttacgggttaacggggttaaacttttacgtttcggttaaccgttccggtttacccgtttcgttacgtaaccggttaccgggtcggggttacccgtaacggggttcccgtttaacccggg

SEQ ID NO: 391716 - DNA, 713 bp, Homo sapiens
  misc_feature: GZ8MTXP01EYGXT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctccgtgacgaaggtcttcgttacgttacctaccctttaaccaacttagtaggttatacgtaggttgggtcgcgacgacggccccgtaggacgaagggtcgttaggaggtgggagtgggagtggagtacgacggcgtacttaacgaagttcggtaccaacgtaaactaaactagttacgaaccccgaaccaaccgtaaaccgtcccggaaggggaacccgaggaacgtacccaaaccaacgtaccgaaacccacgaaacaccaacctacgacccgaaacgggccgaaccgttaccggacctaccgtagtaccgggactagggacgacgaccttagggggaatacgtcgaacggaacgaccggtacggtcgtaattacgttgacggtagcggaagaggttaccggtaggttaaacttggtttacgaccgttcgttccctaagtttccgaacgttcggggacggttacccgtaacgggttaaccgttcgg

SEQ ID NO: 391717 - DNA, 700 bp, Homo sapiens
  misc_feature: GZ8MTXP01AUYTH.39.81.H04.1.454.CMB.2.raw
  modified_base (574)..(574): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctacctttaccaaactatggtatcaggttgggtgacgacacggccccgtaggacgaagggcttgaggtggagtgggatggatcgagtcgtacttaacaagttggtaccaacgaactaaaactacgtacggaccccaacgaacgaaacccctccggaacggggaccaagtaacggtaccaaacccagtacgaacccaacaacgaccaacactacccgaacggacgacgacccggacctaacgacgtacggacctggaacggacgaccgtaggggaacgtagtacgtacggaaccgtaaccgaccgggtccgttaaggtactttacggngtacggacggtaagtaacgaggtaacggggttaaatttacggtttacggacgttcggttaccccttaagtttcggtaacgttccgggtacggggttacccgtaacgggttaaccccgttaaccggg

SEQ ID NO: 391718 - DNA, 626 bp, Homo sapiens
  misc_feature: GZ8MTXP01A8M3H.39.81.H04.1.454.CMB.2.raw
  modified_base (255)..(255): a, c, t, g, unknown or other
  modified_base (304)..(304): a, c, t, g, unknown or other
  modified_base (541)..(541): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgagccgtgggcctgagtgaagtctctgacgagtcttctgttactaccttacatntgtatgtaggttggtgacgacgacggtccctggaacgagggtcttaggnggtggagtgggagtaggatcgacggcgtacttaacgacgttcggtaccaaaccgaactaaacttgacgtaacccaacgaacgaacccgtacggaggaacaaggcgtaccaaccagtaccgaaccacacgaaccacaactccgaacgacgaccaccggtacctagacgtacggacgtagggacgacgtcgtaggacgtacgtacgacggaacgccgaccggtgttatattacgtgagngtaagagttacggtacggttaatttgtacgttcgttccttacgtttgtacgtcggtacggcggaccgtaaccgggttaacgtccg

SEQ ID NO: 391719 - DNA, 745 bp, Homo sapiens
  misc_feature: GZ8MTXP01A5IGO.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtgggatgttgtgatgactcagtctccagtcctccctgcccgtcacccttggacacgccgcctccatctctgcaggtctagtcaaagtcctagtatactattagagtacggaaactccttacttagaatttcggttacagcgaaggacggccaggtacccaaagtcctaccgaagtccgtaactttaaagtttacgtaaacggtttaccgaaacccgggtacttccggtacgggtacccaggtacctaagtacgtttagggcccgtgtaacgggtcgggtacaacgggtctaacgttgtaaactttccgaaaccgtaagttaaacgtaaaacttaccgaaaggaccggtaaggggggtcggtaacgggtaccgttaagggtaagggttagggtttacgggttttaagggggtttaactttaccggtagtaccgtaaggttacggaaccgtaaacgggtaaacctaacggtaccgtccggtacccgttaccgtaccgttaccgtttacgggaaccggtaacgggtaacaaacggtcgttaaggaacgaacgttacgaaacggttacgtcggtcgtaacgtcacgttactaacgttctttaaccg

SEQ ID NO: 391720 - DNA, 642 bp, Homo sapiens
  misc_feature: GZ8MTXP01DXLR5.39.81.H04.1.454.CMB.2.raw
  modified_base (327)..(327): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacacctttaccaactatggtatcagttgggtgcgacaggcccctggacaaggcttggagtggatgggatggatcagcgcttaanaagttggtacaacaacaaactatcgaccaacaagaaccctccgaaggggaccaaggaacgtcaacccaatcgaacccacgacgaaccacaactacccaacgacgacaaccggaccctaacacgtacgggaacccgtaggaacgggaagtcccgtaggggacgtacgttccgtagaaccgacgaccgggtccgttagttattaccgtgtcggcgaaggcggttaagtacggggttaaatttacgtttgacgtttcggttacccttgttttacgaaccgttacggtcgggggaccctaagggttaaccccgttcggg

SEQ ID NO: 391721 - DNA, 798 bp, Homo sapiens
  misc_feature: GZ8MTXP01AIVB9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacggtctccgtgacgtaaggtctttcgtaggttacctacctttaaccaacttataggtattcgaggtttgggtagcgaccgacggtccccgtagggacgaagggtcgttggaaggtggtaagtggggattaggactcgagggtcctactttaacgaagttcggttaccaaaccgtaacgtaaaacttcgacggaccccaaaccggaacgtaaaccccgtcccgggaaggggaacccaagggtaaccgtaccaaacccgagtaaccgacccgtaacaacgaaaccactaacgtaccgacgacgaccgacccgaccgtacacgtacggaccgtacggaagggaccgtactagggacgtacgttccgaaccggaaccgaccgaccggttccgttaacgttaagtttcggacggtggtaccggaaggtaaggttaaacgggttaaaccgggggttaaattttaaacgggttttacgttaacccggttttacggttaaccccgttttcgtttaccggtaaccgggtttacggggtacccgggggttaccggttaaaccgggttaaccccggtttaacccggg

SEQ ID NO: 391722 - DNA, 712 bp, Homo sapiens
  misc_feature: GZ8MTXP01D2EAF.39.81.H04.1.454.CMB.2.raw
  modified_base (490)..(490): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcagtgaaggtctccgtgacaaggtcttctgttactacctttaccaactatgttatcgtaggttgggtgacgacgacggtcccctaggaaccgaagggctttggaggtggagtggggatggactcaggtcgtacttaagaagttcggtaacaactaaaccgaaatacgtacgacccacgaacgaacccgtcgaacgggaacaagcgtacaaccataccgaaccactaacgaccactacacccgacgacgacgacccggtacctagagtcggaccgnggaacggcgacccgtaggggaagtacgtacgacgaaccgaaccggtccggtacgttgttaaacttcgtacggtcgaaccgggtaaggtaacggttaacggggttaaaccgggttaaatttaccgttttacgggaacccgtttcggttaacccctttcggttaacggtaaccgtttacggggaccgggttaaccggtaaccgggttaaccccggttaacccgg

SEQ ID NO: 391723 - DNA, 785 bp, Homo sapiens
  misc_feature: GZ8MTXP01CTNWL.39.81.H04.1.454.CMB.2.raw
  modified_base (216)..(216): a, c, t, g, unknown or other
  modified_base (237)..(237): a, c, t, g, unknown or other
  modified_base (258)..(258): a, c, t, g, unknown or other
  modified_base (269)..(269): a, c, t, g, unknown or other
  modified_base (299)..(299): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtactgtctggagctgagatgacgagccgtggggcctnagtgaggtctctgcagtcttntgttactaccttacatatgtntctaggttggngcgacgcggcccgtggacgaaggtcttggnggtggagtgggatggatcgagcgtacttaacgaagttcggaccaaacgaacctaaaaactgtacgaacccctaacgaaaccgtaacccgtacccggaggggtaaccaggaaccgtacccaaaccgtaacgtaccggaaccccgaataaccgaaaccttaacccgtaacgtaccccgaacggtaacgaccccgtaaacccgggtacccttaacgtacgttaccgggaacccgttagggaaccgggtacgtaacccggtaggtaaaccggtacggttaccgtaccggtaaacccggaaccgggttaaccccgggttacggttaacggtttaaccgttaacgggtcggtaacgggacgtaaagggggttaacggttaaagggttaccgggttaaagttttacggttacggttaaccgtttccggttacctttggttacggtaaccgtttacggggcgggttaccgtaaccggggttcccgttaaccggg

SEQ ID NO: 391724 - DNA, 659 bp, Homo sapiens
  misc_feature: GZ8MTXP01C7N3U.39.81.H04.1.454.CMB.2.raw
  modified_base (358)..(358): a, c, t, g, unknown or other
  modified_base (369)..(369): a, c, t, g, unknown or other
  modified_base (445)..(445): a, c, t, g, unknown or other
  modified_base (568)..(568): a, c, t, g, unknown or other
  modified_base (615)..(615): a, c, t, g, unknown or other
tcagtcgcactagtcacgaccggtgctcgattttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgtaggttgggtgcgacgacggcccccgtaggacaaagggtcttagaggtgagtgggattggatcgagcgtacttacaaagtttggacaanaactaaaactntacgacccacaacgtaaccctacgagggaaccaagcgtacaaacccgatacggaaacccacaacgaccaactaacnccgaaccgagaccgaacggtaacctaaccgaagtcgggaacccttggaacggacgaccgtagggacggtaactacgttacggaacgaaccgaccgggtccgtacggttattaacgttgacggngtaagagttaggtacgggaaatttgtttacgacgttgttaacccttntttacgaagtaaccggtgggaccgtaaccggttaaccgtaacgg

SEQ ID NO: 391725 - DNA, 897 bp, Homo sapiens
  misc_feature: GZ8MTXP01CZ8BF.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcgtgcagtcttcgtgtactaccttacactatgtatcgtaggttggtgacgtacgacggccccgtaggacgaagggtcttaggacgtggagtgggatggatcgagtacgtacttacgaagttcggtaaccaaacgtaacctaaaacgttctacggaaccccaaaccgaaccgtaaccccgtacccggaacggggtacccgtaaacggtaacggtacccaaacccgtaagttaacccgggaaccccaaaccgtaaacgggaaacccaacgtaaccgttaaccccgaaacggggtaaccgaaaccccggtaaccccggggtaacccttaaacccgtacgggtacccggggttaaccgtacggggaaacggggttaccgaccccggttaagggggtaacccggtaacgtttcccgggttaaacgggaaccccggtaaacccggtaacccggggttaccgttttaaacgggttacttttaaacccgggttggggtacggtacgggtaaaacgggtaacgggttaaacggggttaaaccgggggttaaaattttttacgggtttaccgggttaaaccggttttccggttaaccccggttttgtttaaccgggtaaccgtttaccgggggttaccggggaccggttaaacccggggttccccgttttaacccgggg

SEQ ID NO: 391726 - DNA, 647 bp, Homo sapiens
  misc_feature: GZ8MTXP01DODCD.39.81.H04.1.454.CMB.2.raw
  modified_base (405)..(405): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcagtcttctgttacacctttacaatatgtatcagttggtgcgacgacggccccgtaggacgaagggtctaggaggtggagtgggatggatcgagtcgtacttaacgagttcggacaacaaactaaactagtacgaccacaacgaacccgtacgagggaacacgaacgtacaaccanacaaccgacacgaaccacactacccgacgacgtaccgaccggtaacctacgagtcgggaccaggacgacgtccgaggacgtacgtcgtaacgaaccggtaccgtacgggtccgttaagttactttacgaggtcgcggtaaaggagttacgggtaaaggggttaaatttaagtttcgaccgtttcggttacccttggttaccgaacgttacgggcgggttaccaacggggttaacccgttccg

SEQ ID NO: 391727 - DNA, 707 bp, Homo sapiens
  misc_feature: GZ8MTXP01AG7J2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgaaggcttcgtgttacacctttaccaactatggtactcgtaggttggtgcgacgacggccccgtaggaacgaagggtcttggaggtgggatcggggatggatcgagtcgtacttaacgaagtggtaccactaacgaaacttagcgacccaacgacgtaacccgtaccgagggaacacgtaacgtaccaaccgatacgaacccaacacgaaaccacctacacccgaagtacgcccgaacggacctaaccgagtccggaaccgtggaaacggccgtacctaggggaactccgttacgaccggaaaccgtccgtaccggtaccgttaggtaactttcgaggtcgacgggtaaggaaaggttaccggtaaaggggttaaacttcggttttaccgaacgtttcccggttacccttcggttttacgaacggtttacccgggtcgggggaacccgttaacccggggttaacccgttcccggg

SEQ ID NO: 391728 - DNA, 725 bp, Homo sapiens
  misc_feature: GZ8MTXP01COKZE.39.81.H04.1.454.CMB.2.raw
  modified_base (217)..(217): a, c, t, g, unknown or other
  modified_base (611)..(611): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctnaggtgaacggtctccgtgacgtaaggcctttcgtggttacctaaccctttaacaacttagtggttatcgaggttgggtgtcgacgacgggcccctagggacgtaagggtcgttggaggtggaggtggagtggagtcgaggcgtacttaacaagttaggtaccaacaaacgtaaactatcggaacccctaacgaacgaccctacggacgggtaacaacggtcgtaccaaaccgtactacgaaccgaacctaacggaaccctaaccacgtacccgaaccgacgaccgaccgggacctaacgtacggtaccggaccgtagggaacggtacgacgttaggggaactacgcgtaaccggaaccgccgacggtccgttacggttaattcggtgttacggnggaaggtaacggagggttaagggttaacttttaggtttacggttaccgttcggtttacccgtttgttacgtcgttacggggtccgggaacggtcccgggttaacgttccccggg

SEQ ID NO: 391729 - DNA, 587 bp, Homo sapiens
  misc_feature: GZ8MTXP01ATYRO.39.81.H04.1.454.CMB.2.raw
  modified_base (214)..(214): a, c, t, g, unknown or other
  modified_base (445)..(445): a, c, t, g, unknown or other
  modified_base (457)..(457): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacaccttttacaactatggtatcgagttgggtgcgacaggccccctggacaagggcttgagtggatgggatggatcgagtcgctttaacaattggtcacgacaaactatgccacagaacctccagggacagcgtcaaccatacgaccactaagacacataccaacgagacgacgacctacagtcggacttcgaaggacgccnggaacgagtacncgaacgacgcggtcgtagtagttacctggtgcgtaagaaggttagtaccggggaaattacggttagttaacgttcgggttaacccttcgttcgtaacgtaacgtgggaccgtaacgggttaacccgtcgg

SEQ ID NO: 391730 - DNA, 700 bp, Homo sapiens
  misc_feature: GZ8MTXP01CJKT1.39.81.H04.1.454.CMB.2.raw
  modified_base (276)..(276): a, c, t, g, unknown or other
  modified_base (364)..(364): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactccccaggttcagctggtacagtctggagctgagatgacgaagccgtggggcctcagtgaaggtctctgcaaggcttcgtggttacacctttaccaactatggtatcgagttgggngcgtacgacggcccctggacaagggcttaggaggtgagtgggatggatcgagcgtacttaacgaattcggtacaccgtaactaaactntacggaccccacgacgaacccgtcgaaggggtaccaacggtaagtcccaaccgagtaccgaacccacgaacgtacaccgacaccgacgacgaccgaccggccttaaacgcgtacggtcccgtaggaacggacgtcccgtaggggtaacgagttacccgagggacccgaccggtaccggtccgtttaacgtacgtttacggtcggtacggacggtaaggacggttaacgggtaaccggggttaatttaacgtttcgggttaccgttacgggttcccctttgtttacggaacgtttacgggccggggttaacccgtccggggttaaccccgttccggg

SEQ ID NO: 391731 - DNA, 703 bp, Homo sapiens
  misc_feature: GZ8MTXP01CB1Y9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgacaaggtcttcgtggttactacctttaaccaactatggtatcgtaggttgggtgcgacgacggccccgtaggaacgaagggtcttaggaggtggagtgggacgtggatcgaggtcgtacttaacgaagttcggtacaaacgaaactaaactcgtacgaccccaacgaacgaacccgtacgaagggacaacggaacgtaccaaaccgtagtaccgaaccaacaacgaaccacctacgtaccgaacgacgaccgaccggtaccctaacgacgtacggaaccgtggaacggacgccgtaggggaacgtactacgtacgaaccgaacgtccggtacgtagttactaacgtgtacgcgtaaggtagttagggtaaacgggttaaattttacggtttcgttaaaccgttcggtttacccttaagttacgtccgttacgggtcggggttaccggtaaccgggttaacccgttaaccggg

SEQ ID NO: 391732 - DNA, 619 bp, Homo sapiens
  misc_feature: GZ8MTXP01CCBGI.39.81.H04.1.454.CMB.2.raw
  modified_base (214)..(214): a, c, t, g, unknown or other
  modified_base (227)..(227): a, c, t, g, unknown or other
  modified_base (253)..(254): a, c, t, g, unknown or other
  modified_base (259)..(259): a, c, t, g, unknown or other
  modified_base (264)..(264): a, c, t, g, unknown or other
  modified_base (269)..(269): a, c, t, g, unknown or other
  modified_base (278)..(278): a, c, t, g, unknown or other
  modified_base (285)..(285): a, c, t, g, unknown or other
  modified_base (308)..(308): a, c, t, g, unknown or other
  modified_base (328)..(328): a, c, t, g, unknown or other
  modified_base (508)..(508): a, c, t, g, unknown or other
  modified_base (515)..(515): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgaagcgtgggctnagtgagtctctgngagcttctgtacacttacatatgtanngtggngcgancgccngacgaggtntgagtgngtggagtgatcgagtcgacttanacgtgacaacaacgtaaatntcgaacccaacgacgtaaacccgtccggaagggaactacggaactaccaaccgtaacgaccgaaaccaacaacgtaccacacctacaacgacgtaccgaacgtacctaacaggtccgtaaccgagaacggcgtaccgtaggagtactgacggtaacgacgacgtacgttgtaacttacgnggtacgnggttaagagttacggttagggttaaatttcgtttcgaaccgttcggtttaccccttgttaaccgtgggttcggaccgggttaccggtaaccggttcgtaaccgg

SEQ ID NO: 391733 - DNA, 535 bp, Homo sapiens
  misc_feature: GZ8MTXP02FR02E.39.81.H04.1.454.CMB.2.raw
  modified_base (377)..(377): a, c, t, g, unknown or other
  modified_base (447)..(447): a, c, t, g, unknown or other
tcagtcgcactagtcacgaccggtgctcgatttagtagtgtagattcgcgggacccaaaaccacacccctccttgggagaatcccctagatcacagctcctaaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttaccaactatggtatcagttgggtgcgacaggcccctggacaagggcttgagtggatgggatggatcagcgcttacaatgggtcacacaaactatgcaccagaacctcagggcagagtcaccatgaccanagacacatccacgagcacggcctacatggacctgagagcctgagatctgacgacacggccgtgtattacngtgcgagagagtacgggggaaatagttttgacttacggtacccttacgtttgacgtaacgtcgggggccacggggaaccctgggtacc

SEQ ID NO: 391734 - DNA, 514 bp, Homo sapiens
  misc_feature: GZ8MTXP02HRHJA.39.81.H04.1.454.CMB.2.raw
  modified_base (357)..(357): a, c, t, g, unknown or other
  modified_base (398)..(398): a, c, t, g, unknown or other
  modified_base (443)..(443): a, c, t, g, unknown or other
tcagtcgcactagtcacgaccggtgctcgatttagtagtgtagattcgcgggcacccaaaccacaccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacagaacctcaggcngagtcaccatgaccacagacacatccacgagcacggcctanatggacctgagagcctgagatctgacgacacggccgtgtattacngtgcgagagagtacggaaagtagtttagtactagtaaccgtcttcgtactacgtacggcgacggtaaccgg

SEQ ID NO: 391735 - DNA, 556 bp, Homo sapiens
  misc_feature: GZ8MTXP02I0URK.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctcgtatacattgatggaaacactactgaattggttcagcagaggccaggccaatctccaaggccgacctaatttataaggtttcctaaaccgggactcgtggggtcccagacagattcagcgcaggtgggtcaggcactgaattcacactagaaaatcagcgaggggtggaggcgtaggaggtagttggttaggggtttattactgctagtgacgaaaggaacacgacgtcggtacctaccgtactacgtttcggaccgtagggggacccaaggacgttaggagaactacgaaaacgaacgtgacggtactagacaccgactcg

SEQ ID NO: 391736 - DNA, 577 bp, Homo sapiens
  misc_feature: GZ8MTXP02HNUXM.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaggccgaccttaaatttataaaggtttctaaaccgggactcgtcggggtacccagacagacttcagcggcaggtggcaggcatgaaattcacactagaaaatcagcgagggtggagcgtgaggagtaggttagggtttattacgtgcagtgacgaaaggaacacgaacgtcggacccgtaccgtaccttaccgttttacgggacccggtaacgggggaacccaaacggacgtagggaagacgtaacgaaaacggaacgtaaggtcggctacggaccaccactcttcg

SEQ ID NO: 391737 - DNA, 522 bp, Homo sapiens
  misc_feature: GZ8MTXP02I1U55.39.81.H04.1.454.CMB.2.raw
  modified_base (369)..(369): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggggtgcgacaggcccctggacaaggggcttgagtggatgggatggatcagcgcttacaatggtcacacaaactatgccacagaacctccagggccagngtcaccatcgaccacagacacatccacgagcacgcctacatggacctgagagcctgacgatctgacgacacggccgtgtattactgtgcgagagagtcggggaaatagttttgacttggtacctcgttgactacgtgggccagggaaccctgg

SEQ ID NO: 391738 - DNA, 504 bp, Homo sapiens
  misc_feature: GZ8MTXP02F860E.39.81.H04.1.454.CMB.2.raw
  modified_base (359)..(359): a, c, t, g, unknown or other
  modified_base (425)..(425): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactactgaattggtttcagcagaggccaggccaatctccaaggcgcctaatttataaggtttctaaaccgggactctggggtcccagacagacttcagcggcagtgggtcnggcactgaattcacactgaaaatcagcagggtggagctgaggatgttggggtttattactgcatgnaaggaacacactggctccgtacactttggcaggggaccaaagctggacgatacaaacgactaagtggctgcaccatctg

SEQ ID NO: 391739 - DNA, 497 bp, Homo sapiens
  misc_feature: GZ8MTXP02GHZAP.39.81.H04.1.454.CMB.2.raw
  modified_base (396)..(396): a, c, t, g, unknown or other
  modified_base (401)..(401): a, c, t, g, unknown or other
  modified_base (414)..(415): a, c, t, g, unknown or other
  modified_base (417)..(417): a, c, t, g, unknown or other
tcagtcgcactagtcacgaccggtgctcgatttagtagtgtagattcgcgggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcacctaatttataaggtttctaaccgggactctggggtccagacagattcagcgcagtgggtcaggcactgaattcacactagaaaatcagcagggtgaggnagagngtgttggttatgnnangacgaagaacacacgtcgctacgtactcgttcgacgacggacagcgagacgacacaacgaacgagacgcgcgacacactc

SEQ ID NO: 391740 - DNA, 551 bp, Homo sapiens
  misc_feature: GZ8MTXP02IQ99H.39.81.H04.1.454.CMB.2.raw
  modified_base (285)..(285): a, c, t, g, unknown or other
tcagtcgcactagtcacgaccggtgctcgatttagtagtgtagattcgcggggatcaggactcctcagttcaccttctcacaatggggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatcnccaaggcgcctaatttataaggtttctaacgggactctggggtcccagacagattcagcggcagtgggtcaggcactgaattcgacactagaaaatcagcagggtggagctgaggagtgttggggttattacgtgacagtgacgtaaggaacacgaacgtggaccctacggtactaacgtttcggacccgaggggaacccaaggcgtagggaacgaacgtacgaaaacgaaacgtgtaggcgtacgacacccatctacgttacttc

SEQ ID NO: 391741 - DNA, 548 bp, Homo sapiens
  misc_feature: GZ8MTXP02HFPTQ.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggttcagcagaggccaggccaatctccaaggcgcctaatttataaggtttcaaccgggactcgtggggtcccagacagacttcagcgcagtgggtcaggcactgaacttcacactagaaaatcagcagggtggagctggaggagtggttaggggttattacgtgtacagttgacgaaggaacacgacgtcggcctacggtactacgtttcggaccgtacgggggtacccaaaggcgtagggaacgacgtacgaaaacgtacgtgtggactcggacaccacgtactcg

SEQ ID NO: 391742 - DNA, 637 bp, Homo sapiens
  misc_feature: GZ8MTXP02FYOVK.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggttcagcagaggccaggccaatctccaaggcgcctaatttataaggtttctaacgggactctggggtccagacagatccagcgcagtggtcaggcactgaattcacactagaaaatcgagacgaggggtggaggcgtaggaggtagttgggtttagggggtttaattacgttaggtcagttaggacgaaagggaaaccaacgtaacgtcgggtacccttaccggttaacgttacgtttttacgggacccgtaacgggggaacccgtaaaaggtccgttacggggtaaaggaaacttaccgaaaaaacggtaaccgttaagggttcggggaccttacgggacccgtaacccgtaagtttaccgttacggtttacccg

SEQ ID NO: 391743 - DNA, 535 bp, Homo sapiens
  misc_feature: GZ8MTXP02IVOFU.39.81.H04.1.454.CMB.2.raw
  modified_base (363)..(363): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagacctcaggcagngtcaccatcgaccacagacacataccacgacgcacggcctacatcggacctgaggacgcctgagatcgtgacgacgacggccgtgtacttacgtgtgcgagagagtacgggaaattagtttcgacgtggtaccctgtttacgacttacgtcgggaccgacgggaaccctcgg

SEQ ID NO: 391744 - DNA, 536 bp, Homo sapiens
  misc_feature: GZ8MTXP02FZX7B.39.81.H04.1.454.CMB.2.raw
  modified_base (419)..(419): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactatgcacagaacctcagggcagagtcaccatgaccacagacacatccacgagccacggcctacatcggacctgaggancctggagatcgtagaccgacgacggccgtagtacttacgtgtgcgagagacgtacggggaaattgtttacgacttggtaacccttcgtttcgactacgtcggggaccaggggtaccc

SEQ ID NO: 391745 - DNA, 502 bp, Homo sapiens
  misc_feature: GZ8MTXP02IVS5G.39.81.H04.1.454.CMB.2.raw
  modified_base (291)..(291): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggttcagcagaggccaggccaatctcaaggcncctaatttataaggtttcaaccggactctgggtcccagacagattcagcgcagtggtcaggcactgaattcacactagaaaatcagcagggtggaggctgaggatggttgggttatacgtgcagtgacgaaggaacacacgtggcctccgtactacgtttggcgaggggaccagctggagatacaaacgactgaagctagcacgatctgtc

SEQ ID NO: 391746 - DNA, 592 bp, Homo sapiens
  misc_feature: GZ8MTXP02HENI8.39.81.H04.1.454.CMB.2.raw
  modified_base (384)..(384): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccaatcccaggttcagctggtacagtctggagctgagatgacgaagcctggggcctcagtgaaggtctcctgcaaggcttctggttaccacctttaccaactatggtatcagttggtgcgacaggcccctggacaagggctgagtggatgggatggatcagcgcttacaatggtacacacaaactatcgcacagaacctcgaagggcagatacaccatcgaaccanacgacacataccacgagccacggccctaacagtcggaccctggacggacgtcctaggagacttacgacggaaccgacgacgggaccgtagtattacgtgtggacgtagaggaacgtacgggggaaaatttgtttacggaccgttacgggttaacccttacgtttacggtaccgtaacggtcgggggaccccgtaagggggtaaccccg

SEQ ID NO: 391747 - DNA, 601 bp, Homo sapiens
  misc_feature: GZ8MTXP02HO590.39.81.H04.1.454.CMB.2.raw
  modified_base (252)..(252): a, c, t, g, unknown or other
  modified_base (286)..(286): a, c, t, g, unknown or other
  modified_base (292)..(292): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctatgaattggttcagcagaggcaggccaatcncaagcnctaatttataaggtttcaacggatctgggtccagacagatcagcgcagtgggtcaggcactgaattcaacactagaaaatcagacgagggtggaggcgtaggaaggaagttggtttagggggtttaaatttaacgttggactagttaggacgaaaagggaaacgaacaacgttcgggacccttacccggttaacctacgtttttacgggaccgtaaacgggggaacccaaaaggtccgtacgggaacggtaaaacgtaaaccgaaaaacgtaaacgtacggtacggtacgtacgacctaacctacgtcg

SEQ ID NO: 391748 - DNA, 511 bp, Homo sapiens
  misc_feature: GZ8MTXP02FYYNM.39.81.H04.1.454.CMB.2.raw
  modified_base (429)..(429): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtgggatgttgtgatgactcagtctccagtctccctgcccgtcacccttggacagccggcctccatctcctgcaggtctagtcaaagcctcgtatacattgatggaaacactacttgaattggttcagcagaggccaggccaatctccaaggcgcctaatttataaggtttctaaaccgggctctggggccagacagattcagcgcagtgggtcaggcactgaattcacactagaaaatcagcagggtgagctgaggatgttgggttatactgcatgacaaggaacanactggcctcgtactagtttcggaccgtaggggaccaaggcgtaggacgtacgtacgaaacgaacgtgacggctgacaccatc

SEQ ID NO: 391749 - DNA, 631 bp, Homo sapiens
  misc_feature: GZ8MTXP02G16R3.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagaggccaggcccaatctaccaaggcaccttaaatttataaggtttctaaccgggactcgtcggggtcccagacagacttcgagcggcaggtggtcagggcactgaattcacactagaaaatcagcgagggtggaggcgtaggaggtagttgggtttaggggtttattacgtgactagtagacgtaaagggaacaacgacgtacggtacccttacccggttaaccgttacgttttacgggacccggtaacgggggaacccgtaaacggtccgtagggaaacggtaacgttaaccgaaaaccggtaaaccgttaaggtcggtaccgttacggacccgtaaccgtaacgttaccgtttaccg

SEQ ID NO: 391750 - DNA, 568 bp, Homo sapiens
  misc_feature: GZ8MTXP02I2DTN.39.81.H04.1.454.CMB.2.raw
  modified_base (384)..(384): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggtttcagcagaggccaggccaatctccaaggcgacctaatttataaggtttctaaccgggactcgtggggtccagacagattcagcgcagtgggtcagggcactgaattcacactagaaaatnagcgaggggtggagctggaggtattgggttggggtttaattacgtggactagttggacaaagggaaaccacgaacgtcgggcctaccggtactacgttttcggacccgtaacgggggaccaaaggtcgtagggaacgacgtacgaaaacgaaactggtacggactacggctacctattaccttg

SEQ ID NO: 391751 - DNA, 550 bp, Homo sapiens
  misc_feature: GZ8MTXP02HMKG9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcagggcagagtcacatcgacccaacagaccacatacccacgagcacgcctacatggacctgaggagcctgagatctgacgacacggcgtgtacttactgtgcgaggagagtacggggaaattacgttttcgacgttcggtacccttcgtttcgaccgttacggtacggggacccgacggggtaaccccgttcgg

SEQ ID NO: 391752 - DNA, 525 bp, Homo sapiens
  misc_feature: GZ8MTXP02GOWIC.39.81.H04.1.454.CMB.2.raw
  modified_base (416)..(416): a, c, t, g, unknown or other
  modified_base (509)..(509): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaatttataaggtttcaaccgggactcgtggggtccccagacagattccagcgcagtggtcaggcactgaattcacactgaaaatcagcagggtgaggctgagatgttgggttatacgtgnatgacaaggacacacgtggcctaccgtacgtacgttttcggaccgtaagggggaccaaggcgtacggagactacgaaacgaacgtgaaggtcncgacacgactctcgtc

SEQ ID NO: 391753 - DNA, 545 bp, Homo sapiens
  misc_feature: GZ8MTXP02JAIHQ.39.81.H04.1.454.CMB.2.raw
  modified_base (249)..(249): a, c, t, g, unknown or other
  modified_base (284)..(284): a, c, t, g, unknown or other
  modified_base (291)..(291): a, c, t, g, unknown or other
  modified_base (522)..(522): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctattgaattggttcagcagagccaggccaatcncaaggcnctaatttataaggtttcaaccgggactcgtggggtcccagacagattccgagcgcagtggcaggcactgaattcacactagaaaatcagcgagggtggaggcgtagaggagttggttaggggtttattacgtgacgatgacaaggaacaacacgtcggaccctccgtaactacgttttacggaccgaggggtaccaaggccgtaggaagaacgtacgaaaacgtacgtagnggctacgaccacactctcgttac

SEQ ID NO: 391754 - DNA, 552 bp, Homo sapiens
  misc_feature: GZ8MTXP02HIC5P.39.81.H04.1.454.CMB.2.raw
  modified_base (275)..(275): a, c, t, g, unknown or other
  modified_base (368)..(368): a, c, t, g, unknown or other
  modified_base (433)..(433): a, c, t, g, unknown or other
  modified_base (453)..(453): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtacacacaaactatgccacagaaccctcgagggcagngtcaccatcgaccacagacacatccacgagcacggcctacatggacctgaggagcctagagatcngacacgacggcgtgtatacngtgcgagagagtacggggaaaattagttttacgacttcgggtaacccttcgtttacgaacttacggtacgggggacccgaacggggtaaccccttcggg

SEQ ID NO: 391755 - DNA, 579 bp, Homo sapiens
  misc_feature: GZ8MTXP02HBHOI.39.81.H04.1.454.CMB.2.raw
  modified_base (369)..(369): a, c, t, g, unknown or other
  modified_base (383)..(383): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacaacaaactatgaccacagaacctcgagggcagngtcacatcgaccanagacacatccacgagcacgacctacatacgggacctggaaggacgccgtagaacgtatcgtaggaaccgacgaccgggccgttagtacttacgtgtagcgaagacgagtacggggtaaaattacgtttagaaccgttcggtaaccccttgtttacgaaccgttacggtcggggacctaacgggggtaaccctcggg

SEQ ID NO: 391756 - DNA, 744 bp, Homo sapiens
  misc_feature: GZ8MTXP02JBS5V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttcgtggttacacctttaccaactatggtatcagttggtccgacacggccctggacgaaggctgagtggagtgggagtggatcgacggacggtctttaaccgaagttacgggtaccaacaaacctaaaaacttaaacgtcggaaccaacccgaaaccgaaaccccgttacccgaacggggaccaacggaacgttaccgaaacccaacgtacggaacccaaccgaaacgaacctaaacaactccccgaaacggaacgcccgtaaccgggacccttaacgactacgggaaccccgtggaacgggacgaccctaggaacgacttaccgtacggacggaaaccgccggggtaccgttaggttaacttacccgttggtacggaccggtaaggtaacggagttaaccgggggtaaaaactttcgtttttaaggacccgtttcgggtaaccccctttgtttaacggacgtttaaccggtcgggggacccgtaacgggtaacccttcggggtaccc

SEQ ID NO: 391757 - DNA, 571 bp, Homo sapiens
  misc_feature: GZ8MTXP02GRUVV.39.81.H04.1.454.CMB.2.raw
  modified_base (386)..(386): a, c, t, g, unknown or other
  modified_base (469)..(469): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacaacaaactatgaccacagaacctccagggccagacgtcaccatcgaccanagacacataccacgacgcacgctacatcggacctgaggacgcctagacgatcgtaggaacgacgacggtccgtagtacttacngtgcgagagagtacggggtaaaattagttttacgaacgttcgggttaacccctgttttacggaaccttacggtacgggggaccaacggggtaacccttcggg

SEQ ID NO: 391758 - DNA, 562 bp, Homo sapiens
  misc_feature: GZ8MTXP02J21YZ.39.81.H04.1.454.CMB.2.raw
  modified_base (340)..(340): a, c, t, g, unknown or other
  modified_base (363)..(363): a, c, t, g, unknown or other
  modified_base (389)..(389): a, c, t, g, unknown or other
  modified_base (396)..(396): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacatggtcacacaaactntgccacagaaccctcagggcagngtcaaccatcgaccacagacactacnccacgancacgcctacatgacctgagacgcctgagatctaggacgacgaccggccgtagtacttacgtgtagcgagagagtacgggggtaaattacgtttcgaaccgttcgggtaacccttcgtttacgaccgttacggtcgggggacccgtaacgggggtaacccctcgggg

SEQ ID NO: 391759 - DNA, 528 bp, Homo sapiens
  misc_feature: GZ8MTXP02FZSNT.39.81.H04.1.454.CMB.2.raw
  modified_base (363)..(363): a, c, t, g, unknown or other
  modified_base (376)..(376): a, c, t, g, unknown or other
  modified_base (391)..(391): a, c, t, g, unknown or other
  modified_base (449)..(449): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcacacaaactatgccacagaacctcaggcagngtcacatgaccanagacacatccacgancacgcctacatcggactgagagcctgagatcgagacgacgacggccgtgtacttacgngtgcgagagagtacggggaaaattcgtttagactggtaaccctgtttacgactacgtggggacctacgggacccttggg

SEQ ID NO: 391760 - DNA, 535 bp, Homo sapiens
  misc_feature: GZ8MTXP02HLJ1I.39.81.H04.1.454.CMB.2.raw
  modified_base (365)..(365): a, c, t, g, unknown or other
  modified_base (416)..(416): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgcttacaatggtcacacaaactatgccacagaacctcaggcagngtcacatgaccacagacacatccacgagcaacgctacatggacctgaggancctgagatctgacgacacggccgtagtattactgtgcgagagagtacggggaaaattagtttacgacttggtaccccttgtttagaccttaacgtcggggccacggggtaacccctggg

SEQ ID NO: 391761 - DNA, 525 bp, Homo sapiens
  misc_feature: GZ8MTXP02HVRHG.39.81.H04.1.454.CMB.2.raw
  modified_base (294)..(294): a, c, t, g, unknown or other
  modified_base (359)..(359): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggttcagcagaggccaggccaatctccaaggcnctaaatttataaggtttcaaccgggactcgtggggtacccagacagacttcagcggcagtgggcnggcactgaaattcacactagaaaatcagacgagggtggagcgtgaaggtagtggttaggggtttattacgtgacagtgacaaggaacagactcggcctcgtactacgtttggacgtacgggaccaagctaggagactacaaaacgactgtacgctgcaccgatctg

SEQ ID NO: 391762 - DNA, 525 bp, Homo sapiens
  misc_feature: GZ8MTXP02H98V7.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagagcaggccaatctcaagcacctaattataaggttctaaccggatcgtgggtcccagacagatccagcgcagtggtcaggcactgaattcacactagaaaatcagcgagggtggaggcgtagaggtagttggttaggggtttattacgtgacagtgacgaaaggaacacacgtcggacctaccgtactacgtttcggaccgaagggaccaagcgtaggagactacgaaaacgaactgtggctacgcacactctgtc

SEQ ID NO: 391763 - DNA, 550 bp, Homo sapiens
  misc_feature: GZ8MTXP02IM3LE.39.81.H04.1.454.CMB.2.raw
  modified_base (322)..(322): a, c, t, g, unknown or other
  modified_base (365)..(365): a, c, t, g, unknown or other
  modified_base (387)..(387): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgnttacaatggtcacacaaactatgcacagaacctccagggcagngtcaccatgaccacagacacanccagagcacgcctacatggacctgaggagcctgacgatctgaacgacacggcgttgtacttacgtgtgcgaagagagtacgggggaaaattacgttttgaaccgttggtaaccccttgtttaggacctaacgtcgggggacctaacgggggtaacccttcggg

SEQ ID NO: 391764 - DNA, 554 bp, Homo sapiens
  misc_feature: GZ8MTXP02GNJKR.39.81.H04.1.454.CMB.2.raw
  modified_base (379)..(379): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccgaggcagcgtcacatgaccanagacacatccagacgcacgcctacagtcggactgacggagcctagagatctagacgacgacggccgtagtaacttactggtagcgaagagaaggtcggggaaaatttgtttcgaacgttcggtacccttgtttacgacttacggtcggggtacccgtaacggggtaaccccttgg

SEQ ID NO: 391765 - DNA, 536 bp, Homo sapiens
  misc_feature: GZ8MTXP02J1BD7.39.81.H04.1.454.CMB.2.raw
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccagggcagngtcaccatgaccacagacacatccacgacgcacgcctacataggacctgaggagcctagagatcgagacgacgacggccgtgtacttacgtgtgcgagagagtacggggtaaatcgtttagacctggttacccctgtttacggactacgtggggaccagggaaccctcgg

SEQ ID NO: 391766 - DNA, 551 bp, Homo sapiens
  misc_feature: GZ8MTXP02GYQ8M.39.81.H04.1.454.CMB.2.raw
  modified_base (369)..(369): a, c, t, g, unknown or other
  modified_base (384)..(384): a, c, t, g, unknown or other
  modified_base (438)..(438): a, c, t, g, unknown or other
  modified_base (462)..(462): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgaccacagaacctccgagggcaagngtcaccatgacccanagacacatccacgagcacgtcctaacatcggacctgaggacgcctagacgatcngacgacacggccgtagtacttacngtgcgagagagtacgggtaaattagtttcgacttcggttaccctgtttacgaacgttacggtcggggacctaacggggaacccttcggg

SEQ ID NO: 391767 - DNA, 537 bp, Homo sapiens
  misc_feature: GZ8MTXP02HKD27.39.81.H04.1.454.CMB.2.raw
  modified_base (345)..(345): a, c, t, g, unknown or other
  modified_base (375)..(375): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaggcttgagtggatgggatggatcgagcgcttacaagtggtacacaactaaatntgaccacagaacctcgaggcagcgtcacancgaccacagacacatccacgagcacgcctacatgacctgaggacgcctgagatcagacgacacggctagtactacgtgtgcgtagagagtacgggtaaattgtttacgacgttcggtaccttcgtttagacgttcggacgggaccgaacgggtacccgtcgg

SEQ ID NO: 391768 - DNA, 573 bp, Homo sapiens
  misc_feature: GZ8MTXP02HV1ZD.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacaacaaactatgaccacacgaaccctccgagggccagacgtcaaccatcgaaccacagacacatccacgagcacgctacatcgacctgacgagcctagagatctagaccgacgacggccgtagtattacgtgtgacgagacgagtacggggtaaaattagttttacgacgttcggttaacccttcgtttacggtaaccgttacggtacggggacccgtaacggggtaaccccgttcgg

SEQ ID NO: 391769 - DNA, 606 bp, Homo sapiens
  misc_feature: GZ8MTXP02GJ6ML.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtacacacaaactatgccacagaacctccaagggcagcgtcaccatcgaccacagacacatccacgacgcacgcctacatggacctgaggacgcctgaagatctaggaaccgaaccgacgggcccgtaggtaacttaccgtggtacgcgaaggaggtaaggttaccgggggtaaaatttacgttttacgaacgttacgggtttaaaccccttcgttttacggaaccctttaaccggttcgggggaaccccgtaacgggggtaaacccccttcgggg

SEQ ID NO: 391770 - DNA, 519 bp, Homo sapiens
  misc_feature: GZ8MTXP02HWHHU.39.81.H04.1.454.CMB.2.raw
tcagtcgcactagtcacgaccggtgctcgatttagtagtgtagattcgcgggggatcaggactcctcatttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagcagaggccaggccaatctccaaaggcgcctaaatttataaaggttttctaaaccgggactctggggtcccagacagattccagcgcagtggtcaggcactgaattcacactagaaaatcagcagggtgaggctgaggatggttggggttatactgcatgacaaggaacacactaggcctcgtactactttggaccaggggaccaagctaggagaactacaaaacgaactggtggactgcaaccatctgtc

SEQ ID NO: 391771 - DNA, 600 bp, Homo sapiens
  misc_feature: GZ8MTXP02IIV4P.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtgggaatgttgtgatgactcagtctccagtctccctgcccgtcacccttggacagccggcctccatctcctgcaggtctagtcaaagcctcgtatacattgatggaaacactacttgaattgttcagcagaggccaggccaatctaccaaggcgacctaatttataaggtttctaacccgggtctcgtggggtacccagacagacttcgacgcggacaggtgggtcagggcactgaattcacactagaaaatcagcgaggggtggagcgtggaaggtagttgggtttaggggtttatttaacgtggtacagttagacgaaagggaacaccgacgtcggacccttaccgtactacgtttcgggaccgtaacggggtaccaaagcgttaaggaacgtacgttaaccgaaaacgtaaccgtaaggttacggacttacggaccgtaacctacgttcgtttaaccg

SEQ ID NO: 391772 - DNA, 552 bp, Homo sapiens
  misc_feature: GZ8MTXP02F9PQH.39.81.H04.1.454.CMB.2.raw
  modified_base (364)..(364): a, c, t, g, unknown or other
  modified_base (372)..(372): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcaggcagngtcaccancgaccacagacacatcccagacgcacgcctacatggacctgaggagcctagagatctgaacgaccgacgggccgtgttaacttactgtgcggagagagtacggggtaaaattagtttacgacgttggttaacccttgtttacgacttacggtcggggacccaacggggtaacccgttcgg

SEQ ID NO: 391773 - DNA, 567 bp, Homo sapiens
  misc_feature: GZ8MTXP02GTOOV.39.81.H04.1.454.CMB.2.raw
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggggtncgacaggcccctggacaagggcttgagtggatgggatggatcagcgcttacaatggtcacaacaaactatgcccacacgaacctcgagggcagacgtcaacatgaccacagacacatccacgagcacggcctacatcggacctgaggagcctagacgtatctaggacgaaccgacggccgtagtacttactggtgcgaagaggagtacggggaaattagttttcgacgttcggttaacccttcgtttacgacgttacggtcggggacccgtaacggggtaaccctttcggg

SEQ ID NO: 391774 - DNA, 584 bp, Homo sapiens
  misc_feature: GZ8MTXP02GGMNR.39.81.H04.1.454.CMB.2.raw
  modified_base (287)..(287): a, c, t, g, unknown or other
  modified_base (401)..(401): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaaacacctacttgaattggttcagcagagccaggccaatcncaaggcgactaatttataaggtttcaaccgggactcgtgggtcccagacagactcagcggcaggtcgggcagggcactgaattcaacactagaaaatcaagcgaagggtggagntggaggtagtggtttaggggtttattacgtgcagttgacaaagggtaacacgtacgtacggacccttaccgtacttacgtttcggacccggtaacgggggacccaaaggtccgtagggagtaacgtaacgaaaacggtaccgtaaggtacggaccgttcggacctaaccgtacttacgtttcg

SEQ ID NO: 391775 - DNA, 637 bp, Homo sapiens
  misc_feature: GZ8MTXP02FZLIA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaactatggtatcagttgggtgcgacacggcccctggacaagggcttggagtggatgggatggatcaggcgtcttaacaagttcggtacaacaacaaaactatcgaccacaacgaacctccgagggcaaggacgtcaaccatacgaccacacgacacactccaacgacgccacggacctacgacgtacggacctaggacggacgccgtaggagtactcgtaggaaccgacgaccggtacgttagtaacttacgtggtcggacggaaggaggtaggttaacgggggtaaaatttacgttttacggtaaccgtttccgggttaaccctttcgtttacggtaaccgtttacgggtacggggtaccggaacggggtacccgtttacggg

SEQ ID NO: 391776 - DNA, 608 bp, Homo sapiens
  misc_feature: GZ8MTXP02G25ST.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaggcgtacctaaatttataaggtttctaaccgggactcgtggggtcccagacagattccagcgcagtggcaggcatgaatcacactagaaaatcagcgaggggtggaaggcgtaggagggagttgggtttaggggtttattacgtaggctagttagacgaaagggaacaacgacgtacggacccgttaccgtaacgttaccgtttagggacccgaacgggggtaaccctaaaggaccgttagggaacggaacgttaaccgaaaaccggtaaaccgttggtaagggctacggacaaccctaagttccgttagtttcccg

SEQ ID NO: 391777 - DNA, 553 bp, Homo sapiens
  misc_feature: GZ8MTXP02H629M.39.81.H04.1.454.CMB.2.raw
  modified_base (345)..(345): a, c, t, g, unknown or other
  modified_base (394)..(394): a, c, t, g, unknown or other
  modified_base (422)..(422): a, c, t, g, unknown or other
  modified_base (456)..(456): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccccctggacaaggggcttgagtggatgggatggatcagcgcttacaatggtcacacaaaactntgaccacagaacctccaggggcagacgtcaaccatgaccacagacacanccacgagcacgctacatggacctgagancctgagatcagacgacacggccgtgtacttacgngtgacgagagaggtaacgggaaattacgtttacgacgttacggtacccttgtttacgaaccgttacggtacggggacccgtaacgggtaacccgtgg

SEQ ID NO: 391778 - DNA, 619 bp, Homo sapiens
  misc_feature: GZ8MTXP02G30KF.39.81.H04.1.454.CMB.2.raw
  modified_base (400)..(400): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgcttaacaatggtacaacaacaaaactatgaccaacagaaaccctccgaaggggcaaggacgtcaaccagtcgaaccaanacgaacaacataccaacgagcaaccggcctaacaatcgggacctaggaacggagcccgtagaagtaatctacggaacgaacccgacggcccgttagtaacttacgtgtgacggaacgagaggtacgggggaaaatttagtttacgaacgttcggttaaccccttgtttacggaaccgttaacggtcgggggaccctaacgggggtaacccctttcgggg

SEQ ID NO: 391779 - DNA, 569 bp, Homo sapiens
  misc_feature: GZ8MTXP02IB9UA.39.81.H04.1.454.CMB.2.raw
  modified_base (277)..(277): a, c, t, g, unknown or other
  modified_base (284)..(284): a, c, t, g, unknown or other
  modified_base (292)..(292): a, c, t, g, unknown or other
  modified_base (352)..(352): a, c, t, g, unknown or other
  modified_base (379)..(379): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtgggatgttgtgatgactcagtctccagtctccctgcccgtcacccttggacagccgcctccatctcctgcaggtctagtcaaagcctcgtatacattgatggaaacactacttgaattggttcagcagagcagcaatncaaggcnctaattanaagtttcaacggatctggccagacagattccagcgcagtgggtcaggcatgaaattcaanactagaaaatcagacgaggggtgaggngtagaggtagtaggttagggttagttagtagtagtagtagtaagaaagaaacgaacgacgtacgtaccgtaccgttacgttaccgtttacggtaccggaacgggaaccgaacgtacgtacggaacgaacgtaacgtaaaacgtaaacgtacggtaacggtacgtacgtacgaccgtactacgttacgtcg

SEQ ID NO: 391780 - DNA, 586 bp, Homo sapiens
  misc_feature: GZ8MTXP02JUVOW.39.81.H04.1.454.CMB.2.raw
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcaacacaaactatgaccacagaacctcgagggcagngtcaccatgaccacagacacataccacgacgcacgctacatcggacctgacggacgccgtagagatctaggacgacgaccggccgtggtattacgtgtcgacgacggagagtacgggggtaaaattagttttacgacgttacgggttaaccccttcgtttacggtaaccgttaccggttacgggggacccgtaaccgggggtaaaccccgtttcgggg

SEQ ID NO: 391781 - DNA, 574 bp, Homo sapiens
  misc_feature: GZ8MTXP02HQPR7.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatctcaaggcgacctaatttataaggtttctaaccgggactcgtggggtcccagacagattccagcgcagtggtcaggcactgaattcacactagaaaatcagcagggtaggaggcgtaggaggtattggtttaggggtttattacgtggtactagtagtacgaagggaacactaacgtcggacccttaccgtacgtacgttttacgggaccgtaacgggggaccaaacggtctagggaagaactacgaaaacgtaacgtgtaacgggactacggacaacctatcttagtttcc

SEQ ID NO: 391782 - DNA, 600 bp, Homo sapiens
  misc_feature: GZ8MTXP02IYNI3.39.81.H04.1.454.CMB.2.raw
  modified_base (547)..(547): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggtttcagcagaggccaggccaatctaccaaggcgacctaaatttataaggtttcaacggactcgtggggtcccagacaggactcgagcgcgaggtcggacgagcacgtagtaactacaactaactaagaaaactcgaagtacggaggggtacggaggcgtaggaggtagttaggggtttagggtttaattacgtagtagtagtacgaagaaacgaacgaacgtaccgtcggtacccttaccgtaacttacggtttcggaccggtacgggaaccaggtcgtaaggaanaaacgtaacgaaaacgtacgtggtaacgctacgacaacctacttcgtacttcc

SEQ ID NO: 391783 - DNA, 573 bp, Homo sapiens
  misc_feature: GZ8MTXP02IQGQR.39.81.H04.1.454.CMB.2.raw
  modified_base (368)..(368): a, c, t, g, unknown or other
  modified_base (382)..(382): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacaatggtacacaacaaactatgccacagaacctcagggcagngtcacatcgaccanagacacatccagagcacgcctacgatcggacctgacggagcctagacgatctaggaaccgacgacgggccgttaggttacttaccgtggtgacggaagagaggtacggggtaaaattagttttacgaacgttcggttaacccttgtttacgaacgttacggtcggggaccgaacggggtaaccccgtaggg

SEQ ID NO: 391784 - DNA, 544 bp, Homo sapiens
  misc_feature: GZ8MTXP02IXECN.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacaatggtcacacaaactatgccacagaacctcagggccagngtcaccatcgaccacagacacatccacgagcacgctacatcggacctggagagcctagagatcgtaggaccgacgacggccgtagtacttacgtgtgcgaagagagtacgggaaattacgtttacgacttcggtaccttgttacgacgttacgtgggaccgacgggtacccgtaggg

SEQ ID NO: 391785 - DNA, 577 bp, Homo sapiens
  misc_feature: GZ8MTXP02IK6FW.39.81.H04.1.454.CMB.2.raw
  modified_base (280)..(280): a, c, t, g, unknown or other
  modified_base (352)..(352): a, c, t, g, unknown or other
  modified_base (367)..(367): a, c, t, g, unknown or other
  modified_base (378)..(378): a, c, t, g, unknown or other
  modified_base (382)..(382): a, c, t, g, unknown or other
  modified_base (392)..(392): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctcgtatacattgatgaaacactatgaattgttcagcagagcagccaatcncaagcacctaatttataaggttctaaccgggtctcgtgggtcccagacagacttcgagcggcaggtgggtcngggcactgaattcanactagaaaatnaagngagggtgagntggaggtagttgggttaggggttattacgtggtactagttagacgtaaagggaaccaccgacgtcgggacccttacggtactaacgtttcgggaccgtaacgggggacctaaaggcgttaagggaacgtacgtaaacgaaacgtaaacgttggtacggacgttacgacctaccgtattcgttacg

SEQ ID NO: 391786 - DNA, 552 bp, Homo sapiens
  misc_feature: GZ8MTXP02F02SF.39.81.H04.1.454.CMB.2.raw
  modified_base (471)..(471): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttaacaatggtcaacaacaaactatgacccacacgaacctccgaggggcaaggcgtcaaccatcgaccaacagacacatccacgagcacggcctacagtcggacctagacggagcctaggagatcagacgacgacggcgtgtattacgngtgcgagagagtacgggaaattagtttacgacgtcggttaccctgtttacgacgtacgtcggggacctacggggacctcgg

SEQ ID NO: 391787 - DNA, 537 bp, Homo sapiens
  misc_feature: GZ8MTXP02JCPOE.39.81.H04.1.454.CMB.2.raw
  modified_base (251)..(251): a, c, t, g, unknown or other
  modified_base (354)..(354): a, c, t, g, unknown or other
  modified_base (531)..(531): a, c, t, g, unknown or other
tcagtcgcactagtcacgaccggtgctcgatttagtagtgtagattcgcgggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctacaggtctagtcaaagcctcgtatacattgatggaaacnctactgaattgttcagcagagccaggccaatctcaaggcgcctaattataaggtttcaaaccgggctcgtggggtcccagacagacttcagcgcagtgggtcngggcactgaattcaacactagaaaatcagcagggtgaggctggagagtggttgggtttattacgtgcattgacaagggaacacgacgtcggcctacgtactaacgttttcgggccacggggaccaaggccgtaggaacgacgtacgaaacgaacctaaggtcgacgtcgacacctanacttcg

SEQ ID NO: 391788 - DNA, 554 bp, Homo sapiens
  misc_feature: GZ8MTXP02I7GRK.39.81.H04.1.454.CMB.2.raw
  modified_base (366)..(366): a, c, t, g, unknown or other
  modified_base (380)..(380): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccagggcagngtcaccatgaccanagacacatccacgagcacgcctacatggacctgagagcctgacgatctgacgacgacggccgtgtattacgtgtgcgagagagtacggggtaaattagttttagaacgttcggttaaccccttcgtttacgaccgttaacggtcggggtacccgacggggtaaaccccttcggg

SEQ ID NO: 391789 - DNA, 560 bp, Homo sapiens
  misc_feature: GZ8MTXP02GEO2M.39.81.H04.1.454.CMB.2.raw
  modified_base (342)..(342): a, c, t, g, unknown or other
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactntgccacagaacctccagggcagngtcacatgaccacagacacatacccacgacgcacggcctacagtacggacctgaggacgcctagagatcgtagacgaccgacggccgtagtacttacgtgtgcgagacgagtacgggggtaaaattagtttacgacgttcggtacccttcgtttcgacgttacgtcgggggaccgtacggggtaacccgttcggg

SEQ ID NO: 391790 - DNA, 738 bp, Homo sapiens
  misc_feature: GZ8MTXP02HGERC.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctattgaattggttcagcagacggccaggccaatcctaccgaaaggccgaccctttaaaattttaacgttaaacgggttttacctaaaacccggggtactttccggtcgggggtacccccaaggtaaccaggtaactttaccgaggccgggactaagggttcggggttccaggggcctaacgtaggtaaactttccaacaacttaaagaaaaatccgaaaggacgaagggggtagggaagggtacgttaggggaagggtaggtttaggggttttagggggtttttaagtttaaccgtttggacgtaagtttaggaacgtaaacgggaaaccaacgtaaccgtcgggtacccttaccggttaccttacggttttcgggacccgtaacgggggtaaccccaaaggtccgtagggaaacgtacgtaaccgtaaaacgaacgttaagggttacggaccgttacggaccgtaaccctactttaccgtttcg

SEQ ID NO: 391791 - DNA, 562 bp, Homo sapiens
  misc_feature: GZ8MTXP02FRFJA.39.81.H04.1.454.CMB.2.raw
  modified_base (443)..(443): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacagaacctcgaagggcagacgtcaaccatcgaaccacagacacatacccacgagcaacggcctaacatgggacctgacggacgcctagagattcgngaacgacgacggccgttgtattacgtgtagcgagagagtacggggaaattacgttttagacgttcggtaacccttcgtttagaccgttacgtcgggggtacccaacggggtaaaccccg

SEQ ID NO: 391792 - DNA, 511 bp, Homo sapiens
  misc_feature: GZ8MTXP02IGZII.39.81.H04.1.454.CMB.2.raw
  modified_base (436)..(436): a, c, t, g, unknown or other
  modified_base (469)..(469): a, c, t, g, unknown or other
  modified_base (503)..(503): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggtttcagcagaggccaggccaatctccaaaggcgcctaaatttataaggtttctaaccgggactctggggtcccagacagattccagcgcagtgggtcaggcactgaattcacactagaaaatcagcagggtggaggctgaggtatggttggggttatatgcatgacaaggaacanactggctcgtacatttgcgtagggaccaaagcnggagatacaaaacggaactggtggctcgcaaccnctactctc

SEQ ID NO: 391793 - DNA, 550 bp, Homo sapiens
  misc_feature: GZ8MTXP02GXN65.39.81.H04.1.454.CMB.2.raw
  modified_base (364)..(364): a, c, t, g, unknown or other
  modified_base (377)..(377): a, c, t, g, unknown or other
  modified_base (451)..(451): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcaggcagngtcacatgaccanagacacatccacgagcacgcctacatcggacctgagagcctgagatctagacgacgacggccgtgtacttacgngtgcgagagagtacggggtaaattagtttcgacgttcggttaacccttcgtttacgaaccgttacggtcggggacccgtaacggggtaacccgttcggg

SEQ ID NO: 391794 - DNA, 534 bp, Homo sapiens
  misc_feature: GZ8MTXP02FSBFZ.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgaccacagaacctcgagggcagngtcaccatcgaccacagacacatcccacgagcacgcctacatggacctgagagcctgagatcgtagaccgacgacggccgtagtacttactgtgcgagagagtacggggaaaattgtttagactggttaccctgtttcgactacgtcggggaccacggggaccctgg

SEQ ID NO: 391795 - DNA, 612 bp, Homo sapiens
  misc_feature: GZ8MTXP02FZLBU.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggaccaagggcttgagtggatgggatggatcagcgcttaacaagtggtcaacaacaaactatgacccaacagaaacctcgagggccaagagtcaaccatcgaccaacagacacatacccaacgacgacgaacggccctaacatacggacctaggaggaacgccctaggagactctacggacgaaccgacggcccgtgttaacttacgtgtagcggaaggagagtacgggggtaaaattgttttacgaaccgttcgggttaacccttcgtttacggtaaccgttaccggttacggggaccgtaaccggggtaaccccgtttacggg

SEQ ID NO: 391796 - DNA, 519 bp, Homo sapiens
  misc_feature: GZ8MTXP02F0122.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaatttataaggtttctaaccgggactctggggtcccagacagattccagcggcagtggtcaggcactgaattcacactagaaaatcagcagtgtggagctgaggatgttgggttattacgtgcatgacaaggaacacacgtggcctccgtactacgtttggccgtacggggaccaaggcgtaggagactacaaacgaactgtacggactcgcaccatcttcg

SEQ ID NO: 391797 - DNA, 529 bp, Homo sapiens
  misc_feature: GZ8MTXP02IU2X4.39.81.H04.1.454.CMB.2.raw
  modified_base (343)..(343): a, c, t, g, unknown or other
  modified_base (365)..(365): a, c, t, g, unknown or other
  modified_base (379)..(379): a, c, t, g, unknown or other
  modified_base (394)..(394): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctcagggcagngtcaacatgaccanagacacatccacgancacgcctacatgacctgaggagcctgacgatcgacgacgacgacggccgtgtattactgtcgcgagagagtacggggaaattagtttagaactggtacccttgttgactacgtagggtccgaagggtaaccctgg

SEQ ID NO: 391798 - DNA, 622 bp, Homo sapiens
  misc_feature: GZ8MTXP02HIDKT.39.81.H04.1.454.CMB.2.raw
  modified_base (302)..(302): a, c, t, g, unknown or other
tcagtcgcactagtcacgaccggtgctcgatttagtagtgtagattcgcgggggtagtcaggactcctcagttcaccttctcacaatgaggcctccctgctcagctcctggggctgctaatgctctgggtcccaggatccagtggggatgttgtgatgactcagtctccagtcctccctgcccgtcacccttggacagccggcctccatcctcctgcgaggtctagacaaagtcctacgtatacctattgatacggaaacacctacttagaattcggttcagcagcgccagcaatcacagcnctaattatacgttcaacggctcgtcgggtcccagacagtattccgacggcggacgtaggtcgggtacagggcctacgtacgaactttccaacctacgtaaagaaaacgtccgaagtaccggagggggttacgggacggtacgtagggtaaggtgtttggggtttaggggtttattacgtgacgtaagtgaacgtaacgacaccgacgtcggaccgttacgtacgtaccgtttcgggaccgagggtaaccaggcgttagggaactaactaaccgaaagtactcggtaacggctacggccaaccgtgttccttacggttccc

SEQ ID NO: 391799 - DNA, 667 bp, Homo sapiens
  misc_feature: GZ8MTXP02HAR5K.39.81.H04.1.454.CMB.2.raw
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcaggttgggtncgacaggcccctggacaaggcttggagtggatgggatggatcgagcgcttaacaagtggtacaacgaacaaaactatcgaccaacaacgacctacgagggcaagcgtcaacatacgaccacagacactacaccacgacgcaccggcctaacgacgtacggaacctaggaaggacgccgtaggaacgtatcgtacggaaccgaccgaccgggtaccgttagtaacgttaaccgtggtagaccggtaaacggaggtaacggttaaacgggggtaaaaacttttagttttacgggaaaccgtttacgggtttaaccccctttaagttttacggaaacccgttttaccgggtacgggggaccccgtaaaacgggggttaaaccccgtttccgggg

SEQ ID NO: 391800 - DNA, 566 bp, Homo sapiens
  misc_feature: GZ8MTXP02F7NT6.39.81.H04.1.454.CMB.2.raw
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcagcgcttacaatggtacacacaaactatcgaccacagaacctcgagggcagngtcacatacgaccacagacacataccacgaagacaccgacctacagtcggacctaggaggacgccgtagacgtatctaggacgaccgacggccgtagtattactgtgacggtagagagtacggggtaaattagtttacgacgttcgttacccttgtttacgacgtacggtcggggaccgaacgggtaaccgttcgg

SEQ ID NO: 391801 - DNA, 667 bp, Homo sapiens
  misc_feature: GZ8MTXP02JWS41.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttggagtggatggggatgggatcgagcgtcttaacgaagttcggtacacaaactaaactagtcgacccacaacgaaccctacgaggggacaagacgtaccaacctagtacgaaccaacgaacgaaccaacctactacccgaacggaacgacccgaacccgggtaccctaacgaacgtacgggaacccttagggaacgggaacgcccgtaggaacgtacttcgacggaaccgaccgaccgggtccgttagtacttacgtggtacgacggtagacggtaggtacggggttaaaattcgtttacgaccgttacggttaaccccgttgtttacggaccgttacggttcggggaccctaacggggtacccttcggg

SEQ ID NO: 391802 - DNA, 611 bp, Homo sapiens
  misc_feature: GZ8MTXP02G2FAO.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagagccaggccaatctaccaaggcgaccttaaatttataaacggtttctaaccgggactcgtcggggtaccagacagacttcagcggcaggtgggcagggcacgtagaattcaactacagaaaatcgaagcgaggggtggagctaggaggtagttgggtttaggggtttattacgtggactagtagacgaaacgggaacaaccgtaacgtcgggtacccttaccggttaacgttacggttttacgggaccggtaaacgggggtaaccaaaggtcgttaaggggaaactaacgtaaaccaaaacggttaacgtggtacggctacgacctactacttacgttcg

SEQ ID NO: 391803 - DNA, 549 bp, Homo sapiens
  misc_feature: GZ8MTXP02I2XAE.39.81.H04.1.454.CMB.2.raw
  modified_base (366)..(366): a, c, t, g, unknown or other
  modified_base (381)..(381): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaactatgccacagaacctcagggcagngtcaccatcgaccanagacacatccacgagcacgcctacatggacctgagagcctagagatcgtgacgacgacggccgtgtaactactgtgcgagagagtacggggtaaattagtttacgacgttcggttaacccttcgtttacgacgttacgtcgggggaccgtacggggtaacccttcggg

SEQ ID NO: 391804 - DNA, 556 bp, Homo sapiens
  misc_feature: GZ8MTXP02INRMG.39.81.H04.1.454.CMB.2.raw
  modified_base (274)..(274): a, c, t, g, unknown or other
  modified_base (526)..(526): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtctcctgcaaggcttctggttacacctttacaactatggtatcagttgggtncgacaggccccctggacaaggcttgagtggatgggatggatcagcgcttacaatggtcacacaaactatgaccacagaacctccagggcagagtcaaccatgaccacagacacatccacgagcacgcctacatggacctgagagcctgacgatctggaacacgacggccgtgtaacttacgtgtgacgagagagtacggggaaaattacgttttaggaacttcgggtaaccccttcgttttgaacgttacgnggggaccctaagggggtaaaccccctcggg

SEQ ID NO: 391805 - DNA, 584 bp, Homo sapiens
  misc_feature: GZ8MTXP02GEE51.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgcttacatggtcacacaaactatcgcacagaacctccgagggcagagtcaaccatcgaccacagacacataccacgagcacggcctacagtcgacctgaggacgccgtgagatcgtagaacgacgacggtccgtagtactttacgtgtacgacggagaggtaacgtacgggggtaaatttacgttttaggaccgtttacgggttaacccctttcgtttacggacgttaccggttacgggggacccgtaacgggggtaaccccg

SEQ ID NO: 391806 - DNA, 640 bp, Homo sapiens
  misc_feature: GZ8MTXP02HT4JI.39.81.H04.1.454.CMB.2.raw
  modified_base (275)..(275): a, c, t, g, unknown or other
  modified_base (345)..(345): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcgagcgcttacaatggtcacaacaaactntgccacagaacctccgagggccagagtcaaccatcgaaccacagaacacatccacgagcaacggcctaacatcggacctaggacggagcccgtaggacggtattccaggacccgaacgaccgggaccgttaggtaaactttaccgtaggtacgacggtaaaggaacggtaaaggtaccgggggtaaaaatttacgtttttacggaaaccgtttcgggttaaaccccttcgtttttacggtaaccttaaaccgggtcgggggtaacccgtaacgggggtaaaccccgtttccgggg

SEQ ID NO: 391807 - DNA, 551 bp, Homo sapiens
  misc_feature: GZ8MTXP02F5WS6.39.81.H04.1.454.CMB.2.raw
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacaacaaactatgccacagaacctccagggcagngtcaccatcgaccacagacacatccacgacgcacgcctacatcggacctgaggagcctgagatctagacgacgacggccgtgtattacgtgtgcgagagagtacggggaaattagtttacgacgttcggttaacccttgtttacgacgttacggtacggggaccgtacgggtacccgttacgg

SEQ ID NO: 391808 - DNA, 596 bp, Homo sapiens
  misc_feature: GZ8MTXP02GJL54.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacctacctacttgaattggttcagcagaggccaggaccaatcctaccgaaaggccgtaccttaaatttagttaaacgggttttaccgtaaacccggggtacttcgtcggggtacccagacagactcgagcggcaggtgggcaggcactgaacttcaactactagaaaatcgaagcgaggggtggaggcgtaggaggtagttgggttaggggtttattacgtgacgtagtagacgaaacgggaacacgtacgtcggaccgtaccgttactacgtttacggaccggtacggggaccagtcgtaggacgactaacgaaacgacgtgtacggactcgacctactacgtctcg

SEQ ID NO: 391809 - DNA, 541 bp, Homo sapiens
  misc_feature: GZ8MTXP02HSZUP.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggctgagtggatgggatggatcagcgcttacaatggtcacacaaactatgcacagaacctcagggcagagtcacatgaccacagacacatccacgagcacggcctacactggacctgacggagcctgagatctgacgacacggccgtgtattacgtgtgcgaggagagtacggggtaaattagtttacgacttacggttaacccttcgtttacgtactaacggttcggggacctacggggtaaccccg

SEQ ID NO: 391810 - DNA, 546 bp, Homo sapiens
  misc_feature: GZ8MTXP02HAKEY.39.81.H04.1.454.CMB.2.raw
  modified_base (249)..(249): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctactgaattggttcagcagaggccaggccaatctccaaggcgcctaaatttataaggtttctaaacccgggcttcgtcggggtacccagacagacttcagcgcagtggtcaggcactgaattcacactagaaaatcagcgaggggtggaggctaggaggtagttgggttaggggtttattacgtgacagtgacaaggaacacgacgtcggcctacgtactacgtttcggccgtaagggaccaagcgtaggaacgactaacgaaacgtaacgtggtcgactcgacacctatcttcg

SEQ ID NO: 391811 - DNA, 547 bp, Homo sapiens
  misc_feature: GZ8MTXP02FWG0B.39.81.H04.1.454.CMB.2.raw
  modified_base (275)..(275): a, c, t, g, unknown or other
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtcaacaacaaaactatgaccacagaaacctcagggcagngtcaccatcgaccacagacacatccacgagcaacgcctacatcggacctagaggagcctgacgatctagacgacgacggccgtgtattactgtgcgagagagtacggggaaattacgttttagacgtcggtaacccctgtttacgacttacggtggggaccacggggtaaccctcgg

SEQ ID NO: 391812 - DNA, 550 bp, Homo sapiens
  misc_feature: GZ8MTXP02IOB3J.39.81.H04.1.454.CMB.2.raw
  modified_base (341)..(341): a, c, t, g, unknown or other
  modified_base (361)..(361): a, c, t, g, unknown or other
  modified_base (391)..(391): a, c, t, g, unknown or other
  modified_base (427)..(427): a, c, t, g, unknown or other
  modified_base (460)..(460): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggctgagtggatggggatggatcagcgcttacatggtcacacaaactntgcacacgaacctcagggcngagtcaccatcgacacagacacatccacgngcacggcctacatcggacctggacgacgcctgaagnttacgacgaccgacgacggccgtagtattacgngtcgacgagagacgtacggggaaattagtttacgacttacggtaaccttcgtttacgtacgttacgtcggggaccgaacggggtaacccg

SEQ ID NO: 391813 - DNA, 656 bp, Homo sapiens
  misc_feature: GZ8MTXP02H3KMO.39.81.H04.1.454.CMB.2.raw
  modified_base (212)..(212): a, c, t, g, unknown or other
  modified_base (224)..(224): a, c, t, g, unknown or other
  modified_base (226)..(226): a, c, t, g, unknown or other
tcagtcgcactagtcacgaccggtgctcgatttagtagtgtagattcgcggggacccaaaaaccacaccctccttgggagaatcccctagatcacagctcctcaccatggactggacctggagcatccttttcttggtggcagcaacaacaggtgcccactcccaggttcagctggtacagtctggagctgagatgacgaagcctgggcctnagtgaagtctcngnagtcttgtgtactacttacatatgtatgaggtggtgcgacgacggcccgtaggaacgaaggtcttaggaggtggagtggtagtagagtacgagcgtactaacgtaagtacggtacaacaaacaaaactaagtacgacccaacaaccgaaccgtaccgacggacgaacgacgtaccaacacgacgaaccaacgaacgaaccaaaccaacaccgaacgaacgaccgaccgacctacgaacgtacggtaccgtacgaacggacgtacgtagagtaacgtacgtacggaccgaaccggaccggtaccgtacgttaacgttacgtacgtacgacgaacggaaggaacggtaacggtaaagttaacgtttacgtacgttacgttaccgttaacgttacgtacgtacggtacggtaccggtaccggtaaccggtacg

SEQ ID NO: 391814 - DNA, 512 bp, Homo sapiens
  misc_feature: GZ8MTXP02JU0NO.39.81.H04.1.454.CMB.2.raw
  modified_base (284)..(284): a, c, t, g, unknown or other
  modified_base (432)..(432): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatcnccaaggcgctaatttataaggtttctaaccgggatctggggtcccagacagattccagcgcagtgggtcagggcactgaattcacactagaaaatcagcagggtggaggcgtgagagtgttgggttagttatgcatgcagacgacacncgctcgtactactttagtcgacgggaccgaacgacgcggaggaatacgaaacgaacgtagtgcgtagcacactcttcgtc

SEQ ID NO: 391815 - DNA, 559 bp, Homo sapiens
  misc_feature: GZ8MTXP02JS43U.39.81.H04.1.454.CMB.2.raw
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttggagtggatgggatggatcgaacggtaacagtggtctacaacaaattatgcacagaagtttcagggcngggtcacatgaccgagggacacgtaccatacaaatacagccctacagcggaaactggacgacgaggcgtagaagtacgtctaggacgacgacggtccgtagtagttattagtgacgagagtagagtagttactcttcgtaatgtaagggttacggggtattaagtagttcggttaccggacccgtacgggg

SEQ ID NO: 391816 - DNA, 569 bp, Homo sapiens
  misc_feature: GZ8MTXP02GRNLL.39.81.H04.1.454.CMB.2.raw
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcaacacaaaactatgaccaacagaacctccaggggccaagcgtcaaccatcgacccanagacacataccacgagcacgcctacatgacctgaggagcctagagatcgtagacgaccgacggccgtagtacttactgtcgcgagagtagtacgggggtaaattagtttcgaacgttcggttaccccttaagtttaggaaccttacggtacggggaccgtaacggggtaacccttcggg

SEQ ID NO: 391817 - DNA, 597 bp, Homo sapiens
  misc_feature: GZ8MTXP02HBUZ4.39.81.H04.1.454.CMB.2.raw
  modified_base (252)..(252): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctagtatacattgataggaaacncctattgaattggttcagcagagccagccaatcacaaggcacttaatttataacggttcaaccgggtctcgtcgggtaccagacagacttcgagcggactaggtcgggtcagggctacgtagaacttccaactactaagaaaatcgaaggcgagggtaggagtcgtaggaggtagttcgggtttagggtttattacgtgactagtagacgaagggaacacgtacgtcggtacctaccgttacgtacgtttcggaccggtaacggggaaccaaggtccgtaggaacgtacgtaaccgtaaacggtaacgtggtacggacgtacggaccctaacgtactcgtttacg

SEQ ID NO: 391818 - DNA, 567 bp, Homo sapiens
  misc_feature: GZ8MTXP02GIAWF.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgccacagaacctcgagggcagngtcaccatgaccacagacacatacccacgacgcacgcctacatcgacctgaggagcctgagatcgtgaccgacgacggcgtagtacttacgtgtgcgagacgagtacggggtaaattagtttacgaacgttcgggttaacccttcgtttacgtaaccgttacggtacgggggacccgtaacggggtacccctttacgggg

SEQ ID NO: 391819 - DNA, 573 bp, Homo sapiens
  misc_feature: GZ8MTXP02IGM0E.39.81.H04.1.454.CMB.2.raw
  modified_base (369)..(369): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacaacaaactatgccacagaacctcgagggcagngtcacatgaccacagacacatccacgagcacgcctacatcggacctgaggacgccgtagagatctacggacgaccgaccggccgtgtacttacgtgtgcgagagagtacggggtaaaattacgtttacgacgttcggttacccttcgtttacgtaaccgtttacggtacgggggtacccgtaacgggggtaaccccgttcgggg

SEQ ID NO: 391820 - DNA, 560 bp, Homo sapiens
  misc_feature: GZ8MTXP02F36IP.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaggcaccttaaattttataaaggtttcctaaaccggggacttcgtcggggtacccaggacagattcagcgcagtgggtcaggcactgaattcacactagaaaatcagcgagggtgaggctaggaggtagttggttaggggtttatacgtgcatgacgaaaggaacacgaactcgggaccctccgtactacgttttcggaccgaggggacctaaaggctaggagtaactacgaaaacgtaacgtggtacggctaggaccaccattccg

SEQ ID NO: 391821 - DNA, 623 bp, Homo sapiens
  misc_feature: GZ8MTXP02IUI1G.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcagcgcttacaatggtacacaacaaactatgccacagaaccctccagggcagacgtcaaccatacgaccacagacaacactccaacgagccgaaccggaccctaacagtcgggaaccctggaaggaacgccctaggaacgtatccgtacggaaccgaaccgaccgggcccgttagttaactttaccgtgtacgacggaaggaggaacggttacgggggaaaatttagtttacgtaccgttacgggtaccccttcgtttacgacgtttaaccggcgggggtaccctaacgggggtaaccccgttcggg

SEQ ID NO: 391822 - DNA, 538 bp, Homo sapiens
  misc_feature: GZ8MTXP02I9R4A.39.81.H04.1.454.CMB.2.raw
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcagggcagngtcacatgaccacagacacatcccacgagcacggctacatcggacctgagagcctgagatctagaccgacgacggccgtgtacttacgtgtgcgaagagagtacggggaaatacgttttgaacttcggtaaccctcgttcgacgttacgtagggaccacggggaacccttggg

SEQ ID NO: 391823 - DNA, 571 bp, Homo sapiens
  misc_feature: GZ8MTXP02HRDZE.39.81.H04.1.454.CMB.2.raw
  modified_base (346)..(346): a, c, t, g, unknown or other
  modified_base (407)..(407): a, c, t, g, unknown or other
  modified_base (484)..(484): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacaacaacaaaactntgacccaacacgaaccctccgaggggccaaggacgtccaaccatcgaaccacagacactancccagaacgcacgcctacagtcggacctgaggacgcctagagtatcgtagaccgacgacggtccgtagtacttacgngtcgacgagagtagtacggtaaatttacgttacgtacgtaccgttacttcgttacgacgtacggtcgggtaccgtacggtaccgtcg

SEQ ID NO: 391824 - DNA, 614 bp, Homo sapiens
  misc_feature: GZ8MTXP02FZICG.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgacctaatttataacggtttctaaccgggactctggggtaccagacagattcagcggcaggtgggtcagggcactgaacttcacactagaaaatcagcgaggggtggaggctaggagggtagttaggtttgggggtttaattacgtggactagttggacgaaagggaaaccacgtaacgtcggtacccgttccggttaaccgtacgtttttacggggacccgacgggggtaacccaaaggtccgttagggacgtaacgtaccgtaaaaacggtaacgtacgggttacggaccgttacggaccaaccgtaactttcccg

SEQ ID NO: 391825 - DNA, 571 bp, Homo sapiens
  misc_feature: GZ8MTXP02IHWLC.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttgagtggatgggatggatcagcgcttacatggtcacacaaactatgaccacagaacctccagggcaagcgtacaccatgaacccacgaagaccaacactacccacgacgacaccggacctaacatacggacctagaggacgaccgtgaacgatcgtagaacgacgacggaccgtagtacttactgtagacggagacgagtacggggaaaattgtttacgaacttggtaacccttgtttcgaacttacggacggggccaacgggtaacccgtcgg

SEQ ID NO: 391826 - DNA, 528 bp, Homo sapiens
  misc_feature: GZ8MTXP02G0BB1.39.81.H04.1.454.CMB.2.raw
  modified_base (275)..(275): a, c, t, g, unknown or other
  modified_base (365)..(365): a, c, t, g, unknown or other
  modified_base (378)..(378): a, c, t, g, unknown or other
  modified_base (510)..(510): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtcacacaaactatgccacagaacctcagggcagngtcacatgaccanagacacatccagagcacgcctacatcggacctgaggagcctagagatcgtagacgacgacggccgtagtattactgtgcgagagagtacggggaaattgtttacgacttggtaccctgtttacgacttacgngggccacggggacctcgg

SEQ ID NO: 391827 - DNA, 568 bp, Homo sapiens
  misc_feature: GZ8MTXP02I72GZ.39.81.H04.1.454.CMB.2.raw
  modified_base (249)..(249): a, c, t, g, unknown or other
  modified_base (282)..(282): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacnctattgaattggttcagcagagccagccaatcnccaaggcactaatttataagttcaaccggatcgtggggtcccagacagtatccagcgcaggtggtcaggcactgaaacttcgacacgtagaaactcgagacgaggggtaggaggcgtagaggtagttgggtttagggtttattacgtgactagtagacgaaaggaaccacgtaccgtcggacccttaccgttactacgtttacgggacccgtaaggggaacctaaggcgtaggaacgaactacgaaaacgtctaggtcggtactacgaccacgtactcgtacttcc

SEQ ID NO: 391828 - DNA, 572 bp, Homo sapiens
  misc_feature: GZ8MTXP02F6S7W.39.81.H04.1.454.CMB.2.raw
  modified_base (344)..(344): a, c, t, g, unknown or other
  modified_base (366)..(366): a, c, t, g, unknown or other
  modified_base (381)..(381): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaaactntgccacagaacctcagggcagngtcaccatcgaccanagacacataccacgagcaacggcctaacatcggaccctgacggagcccgtagagatcctaggaccgacgacggccgtgtaacttacgtgtgacgaaggagagtacgggggaaaattagttttacgacgttacgggttacccctgttttacgacttaacgtcgggggtacctaacggggaaccctttcgggg

SEQ ID NO: 391829 - DNA, 608 bp, Homo sapiens
  misc_feature: GZ8MTXP02G47KR.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagcccggcctccatcctcctgcaggtctagtcaaagcctcgtatacattgataggaaacacctactgaattggttcagcagaggccaggaccaatctccaaggcgtacctaatttagtaaggttcgaaccgggtctcgtcggggtacccagacagacttcgagcggcaggtggcagggccagtagaattccaacactagaaaatcaagacgaggggtaggaggctaggaggtagttagggttagggggtttaattacgtagtacgtagtagacgaaacgggtaaacacgtacgtacgggtccctaccggttaactacggttttacggacccggtaacgggggacccgtaaggccgtagggacgtaacgtaacgaaacggtactaaggtacggctacggacacctagtactttcg

SEQ ID NO: 391830 - DNA, 571 bp, Homo sapiens
  misc_feature: GZ8MTXP02INNKL.39.81.H04.1.454.CMB.2.raw
  modified_base (285)..(285): a, c, t, g, unknown or other
  modified_base (351)..(351): a, c, t, g, unknown or other
  modified_base (361)..(361): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctcgtatacattgatggaaacacctattgaattggttcagcagagccaggccaatcncaaggcgacctaatttataaggtttctaaccgggctcgtcggggtcccagacagacttcgagcggnaggtgggtcngggcacgtagaaacttcaacactagaaaatcgagacgaggggtggaggcgtaggaggtagttgggtttaggggtttattacgtgacgtagtgacgaagggaacacgacgtcggtacctacgtactacgtttcggaccgtaacggggaccaaaggcgtaggacgacgtaacgaaacgtaacgtgtacggactcggacctacctactactcg

SEQ ID NO: 391831 - DNA, 540 bp, Homo sapiens
  misc_feature: GZ8MTXP02GOEO9.39.81.H04.1.454.CMB.2.raw
  modified_base (499)..(499): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactattgaattggttcagcagaggccaggccaatctaccaaggcaccttaatttataaggtttctaaccgggactcgtggggtcccagacagatccagcgcaggtggcaggcactgaattcacactagaaaatcagcgaggggtgaggctaggaggtattggtttaggggtttattacgtgctagtgacgaaggaacacgacgtcggaccttccgtaactacgtttcggacgacgggacaaggcgtagganacgtacgaaaacgactgtaaggctacgacaccatctgttcc

SEQ ID NO: 391832 - DNA, 563 bp, Homo sapiens
  misc_feature: GZ8MTXP02HQ2W1.39.81.H04.1.454.CMB.2.raw
  modified_base (247)..(247): a, c, t, g, unknown or other
  modified_base (290)..(290): a, c, t, g, unknown or other
  modified_base (303)..(303): a, c, t, g, unknown or other
  modified_base (330)..(330): a, c, t, g, unknown or other
  modified_base (340)..(340): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatgaaacnctatgaattgttcagcagagcagcaatcacagcactaatttanaggttcaacgggntcgtgggccagacagtactcgagcggnaggtcggtcnggcactgaacttcaacactagaaaatcgagcgaggggtggaggcgtaggaggtagttgggtttagggtttattacgtgactagtagacgaaaggaacaacgacgtcggtaccgtaccgttacgtacgtttacggaccggtaacggggaaccaggacgtaggaacgtaacgaacgtaaaacggtacgtggtacggacgtacgacctaccgtacgttcgtttacg

SEQ ID NO: 391833 - DNA, 582 bp, Homo sapiens
  misc_feature: GZ8MTXP02FVDFL.39.81.H04.1.454.CMB.2.raw
  modified_base (343)..(343): a, c, t, g, unknown or other
  modified_base (365)..(365): a, c, t, g, unknown or other
  modified_base (378)..(378): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctcgaggcagngtcacatgaccanagacacatcccacgagcacggcctacatggacctaggaggacgcctagagatctaggaacgaaccgacggccgttagttacttacgtggtgcggaagaggacggtacggggtaaaatttacgttttacgaccgttcgggttaaccccttgtttacggaaccgttacggtcgggggtaccctaacgggggtaaccccttacgggg

SEQ ID NO: 391834 - DNA, 596 bp, Homo sapiens
  misc_feature: GZ8MTXP02H1SPC.39.81.H04.1.454.CMB.2.raw
  modified_base (356)..(356): a, c, t, g, unknown or other
  modified_base (410)..(410): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccgctccatctctgcaggtctagtcaaagcctcgtatacattgataggaaacacctacttgaattggttcagcagaggccaggccaatctaccaaaggcaccttaatttagtaaggtttacctaaccgggactcgtggggtccccagacagatccgagcgnaggtggtcaggcactgaaacttcaacactagaaaatcaagcgaggggtggaggngtaggaggtagttgggtttaggggtttattacgtgtcagtgacgaaaggaacacgacgtcggaccttaccgtacgttaccgtttcgggacccgaacggggacccgaaaggtccgtaggaacgtaacgtaacgaaaaccggtacttaggtaaggcctacggaccacctaacgttccgtttacgttcc

SEQ ID NO: 391835 - DNA, 597 bp, Homo sapiens
  misc_feature: GZ8MTXP02HHR83.39.81.H04.1.454.CMB.2.raw
  modified_base (348)..(348): a, c, t, g, unknown or other
  modified_base (371)..(371): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatgggatcgagcgcttacaatggtacacaacaaactntgccacagaacctccagggcagngtcaccatcgaccacagacacatcccagagcacgcctacagtcggacctgaggacgcctagagtatcgacggaacgaccgacggtccgtagtaactttaccgtggtcgacggaaggacggacggttacgggggtaaaatttagtttttacggacgtttacgggttaaccccttgttttacggaccgttacggtcgggggaccctaacgggggtaaccccttcgggg

SEQ ID NO: 391836 - DNA, 560 bp, Homo sapiens
  misc_feature: GZ8MTXP02I3ECL.39.81.H04.1.454.CMB.2.raw
  modified_base (322)..(322): a, c, t, g, unknown or other
  modified_base (390)..(390): a, c, t, g, unknown or other
  modified_base (432)..(432): a, c, t, g, unknown or other
  modified_base (441)..(441): a, c, t, g, unknown or other
  modified_base (477)..(477): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaaggcttgagtggatgggatggatcgagcgnttacaagtggtacacaacaaactatgccaacacgaaccctcaggggcaagagtcaaccatacgaccanagacacactccacgacgcaacgcctacatcggactagaggancctagaagntctagacacgacggccgtgtattacgtgtgcgaagngaaggtacgggaaaattacgtttcgaacttcggtaacccttgtttcgaacgtacgtcggggaccgtaacggtaacccgttcgg

SEQ ID NO: 391837 - DNA, 591 bp, Homo sapiens
  misc_feature: GZ8MTXP02HGB4R.39.81.H04.1.454.CMB.2.raw
  modified_base (374)..(374): a, c, t, g, unknown or other
  modified_base (440)..(440): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttactaactatgtatcagtgggtgcgacaggccccgtggacgaaggcgtgagtggagtgggagtggagtcagcgcttacaatggtcacaacaaactaatgaccacacgaacctaccgagggacagngtacaccactagaccacagacactatacccacgagactaccgacctacagtcggacctgagggacncctagagatccgtagaaccgaacgacggccgttagtacttacgtgtcgacggaagaggtagtacgggggtaaaattagttttcgaaccgtcgggttaaccccttgtttacgacgtttaccggtcggggaccctacggggtaaccccttggg

SEQ ID NO: 391838 - DNA, 613 bp, Homo sapiens
  misc_feature: GZ8MTXP02G8MZ6.39.81.H04.1.454.CMB.2.raw
  modified_base (444)..(444): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaaggggcttggagtggatgggatggatcgagcgacttacaagtggtacacaacaaactatgacccaacacgaaaccctccgagggccaggcgtcaccgatcgaccacagacacatacccacgagccacggcctacagtcggacctgagggacnccgtaggagtataccgtaggaccgaccgaccgggtcccgttagtaacgtttaccgtaggtcgacggtaaggacgtaaggtacggggtaaaatttagtttacgaacgttcggttaaccccttgtttacgaccgttacggtacggggacccgtaacggggtacccttacgg

SEQ ID NO: 391839 - DNA, 712 bp, Homo sapiens
  misc_feature: GZ8MTXP02FYEZQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaagggcttgagtggagtgggatggatcgagcgtcttaacaatcggtacaacaacaaactatgacccaacacgaacctccgagggacagacgtccaacagtcgaacccaacgacgacacactcccaacgacgacgaccggacctacgaacgtcggaccctaggacggacgcccgtaggaacgtagtccgtacgggaaccgaacccgaccgggtacccggttaggttaaactttaccgtgggttacggaccggtaaaggtaacgggtaagggtttaaaccgggggtaaaaatttttacggtttttacggtaaaccgtttaccggggtttaaaccccctttaaggtttttaacgggaaacccgtttaccgggggttaccgggggtaaccccgtaaaccggggggttaacccctttaccggggg

SEQ ID NO: 391840 - DNA, 561 bp, Homo sapiens
  misc_feature: GZ8MTXP02GQSIW.39.81.H04.1.454.CMB.2.raw
  modified_base (251)..(251): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaaacncctacttgaattggttcagcagaggccaggccaatctccaaggcgaccttaaatttataaggtttctaaccgggactcgtggggtcccagacagacttcagcggcaggtgggtcaggcactgaaattcaacactagaaaatcaagacgaggggtggagcgtaggaggtagttgggttagggtttattacgtgactagtgacaagggaacacgacgtcggcctaccgtactacgtttcggaccgtacggggaccaagtcgtaggaacgacgtaacgaaacgtaacgtggtacgctacgccacctatcttcg

SEQ ID NO: 391841 - DNA, 679 bp, Homo sapiens
  misc_feature: GZ8MTXP02IYNHU.39.81.H04.1.454.CMB.2.raw
  modified_base (387)..(387): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacaacaaactatgaccaacagaacctccgagggccagcgtcaacatgacccaanacgactaacactaccgaacgacgaccaaccgggtaccctaacgaacgtcgggaacccgttagggaacgggtacgacccgttaggaacggacttccgtacgggaaccgaacccgaccggggacccgtttaggtaaacgtttaccgtggttacggaccggtaaacggtaggtaaacggtaaccgggggtaaaatttacgttttacggaaccgtttcgggttaaccccttaacggttttacgaaaccgttaccggtacgggggtacccgaaccgggggtaaacccctttccgggg

SEQ ID NO: 391842 - DNA, 578 bp, Homo sapiens
  misc_feature: GZ8MTXP02HYO7C.39.81.H04.1.454.CMB.2.raw
  modified_base (306)..(306): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggangggatggatcagcgtcttacatggtcacacaaaactatgaccacacgaacctcgagggccagcgtcaaccatcgaaccacagtaaccaacactaccacgacgacaacggcctacagtcggaacctaggaggaagccgtagaggtaatcgtaggacgacgacggaccgtagtattacgtgtgacgtagagtagtacggggtaaattagtttacgaacgttcggtaacccttgtttacgaccttacggtcgggaccgtacgggtaaaccctcgg

SEQ ID NO: 391843 - DNA, 544 bp, Homo sapiens
  misc_feature: GZ8MTXP02JHZBA.39.81.H04.1.454.CMB.2.raw
tcagtcgcactagtcacgaccggtgctcgatttagtagtgtagattcgcggggactgatcaggactcctcagttcaccttctcacaatgaggctccctactcagctcctggggctgctaatgctctgggtcccaggatccagtggggatgttgtgatgactcagtctccagtctccctgcccgtcacccttggacagccggccccatctcctgcaggtctagtcaaagcctcgtatacattgatggaaacacctacttgaattggttcagcagaggccaggccaatctcaaggcgacctaatttataaggtttctaaccgggactcgtggggtcccagacagattccgagcgcagtggtcaggcactgaaacttcacactagaaaatcagcgagggtgagcgtgagagtggttgggttattcgtgcatgtacaaaggaacacgacgtcggccttaccgtactcgtttacggaccgaggggtaccgaaggcgttaggacgtaacgtaccgaaaacgtactagtggctagacactactctagttcc

SEQ ID NO: 391844 - DNA, 546 bp, Homo sapiens
  misc_feature: GZ8MTXP02FWGZ4.39.81.H04.1.454.CMB.2.raw
  modified_base (374)..(374): a, c, t, g, unknown or other
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaaactatgaccaacacgaaacctccgagggcaagngtcaaccatcgaccanagacacatccacgagcacgcctacatgacctagagagctgagatcgtagacgacgacggccgtagtacttacgtgtgacgagagagtacggggaaattacgtttcgactcggttaccctgttcgacgtacgtcggggaccgtacgggaaccctcgg

SEQ ID NO: 391845 - DNA, 578 bp, Homo sapiens
  misc_feature: GZ8MTXP02HTA34.39.81.H04.1.454.CMB.2.raw
  modified_base (377)..(377): a, c, t, g, unknown or other
  modified_base (443)..(443): a, c, t, g, unknown or other
  modified_base (490)..(490): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaagtggtacacaactaaaactatgaccaacaagaaccctcaggggcaagngtcaaccatacgacacaagaccactacaccacgagcaacgcctaacgatcggaacctggaaggacnccgtagaacggattccgagaaccgacgaacggccgtagtacttacgngtagacgagagtaggaacggtaaattacgtttacgacgttacgtaccttgttacgaacgtacggacgggaccgtaacggtaccgtcgg

SEQ ID NO: 391846 - DNA, 617 bp, Homo sapiens
  misc_feature: GZ8MTXP02J4D5O.39.81.H04.1.454.CMB.2.raw
  modified_base (243)..(243): a, c, t, g, unknown or other
  modified_base (281)..(281): a, c, t, g, unknown or other
  modified_base (365)..(365): a, c, t, g, unknown or other
  modified_base (397)..(397): a, c, t, g, unknown or other
  modified_base (406)..(406): a, c, t, g, unknown or other
  modified_base (413)..(413): a, c, t, g, unknown or other
  modified_base (419)..(419): a, c, t, g, unknown or other
  modified_base (429)..(429): a, c, t, g, unknown or other
  modified_base (504)..(504): a, c, t, g, unknown or other
tcagtcgcactagtcacgaccggtgctcgatttagtagtgtagattcgcggggacccaaaaaccacacccctccttgggagaatccctagatcacagctcctcaccatggactggacctggagcattcctttttcttggtggcagcaacaacaggtcgcccactcccaggttcagctggtacagtctggagctgagatgacgaagccgtggggcctcgagtgaaggtctcctgcaaggtcttntgttacctacctttacaactatggtatcgaggttgggngcgacgacggccccgtggacgaaggtcttggagtggagtgggatggatcgagtcgtacttacaagtcgtacaacaactaaactnacgaccaacacgaccctcgaggcagcacaacnacgacacanacacacncagacncgacgcctanacgtacggaccgagacggacgccgtagacgtacttacgacgggaaccgacgccgggttactagttaacgttcggngacggagtaaggtacggtaaggttaacggttaaatttcggttacgtaccgtttaccgttaccgttaacgttacgtacggtacgggtaccgggaccgtaaccgggtaccctcgg

SEQ ID NO: 391847 - DNA, 689 bp, Homo sapiens
  misc_feature: GZ8MTXP02JGUL3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatgggatcgagcgcttaacaagtggtacaacaacaaaactatgaccacaacgaaccctccgagggcaagacgtcaaccatcgaaccacgagacaacactacccaacgacgcaacggaccctacgacgtcggaaccctaggacggaacgcccgtaggaacggtactaccgtacggaaccgaaccgaaccgggtcccggttaggttaacttaaccgtgggttacggaccggaacggtaagggtaacgggttaaaccgggggtaaaatttacggtttttacggaaacccgtttacgggtttaacccccgtttaacgtttacggtaaccgttaccgggttaccgggggtaacccgtaacgggggtaaacccccgtttacggggg

SEQ ID NO: 391848 - DNA, 529 bp, Homo sapiens
  misc_feature: GZ8MTXP02F5LP3.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacacctacttgaattggttcagcagagccaggccaatctcaaggcacctaatttataaggtttcaaaccgggactctggggtccagacagattcagcgcagtgggtcaggcactgaattcacactagaaatcagcgagggtgagctgaggatggttgggtttattactgacagtgacgaaaggaacacacgtggcctaccgtactacgtttacggaccgtacggggaccaaacgcgtaggacgtaactacgaaaacgaacgtgtacggctagacaccatcg

SEQ ID NO: 391849 - DNA, 560 bp, Homo sapiens
  misc_feature: GZ8MTXP02HNBEH.39.81.H04.1.454.CMB.2.raw
  modified_base (249)..(249): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctactgaattggttcagcagaggccaggccaatctccaaggcactaatttataaggtttcaaccgggatcgtggggtcccagacagatccagcgcaggtggcaggcactgaacttcacactagaaaactcagcgaggggtggaggcgtggaggtagttgggtttaggggtttattacgtgactagtagagaaggaacacgacgtcggacctaccgtactacgtttcggaccgtacggggaccaaggcgtaggacgtacgtacgaaacgtaacgtggtaacggctacggaccaccgtactcgtacgtttcc

SEQ ID NO: 391850 - DNA, 565 bp, Homo sapiens
  misc_feature: GZ8MTXP02HHOHX.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgacttacaagtggtcacaacaaactatgaccacagacctcgaggcagcgtcacatcgaccacagacacactcccacgagcgacgctacagtcggacctgagacgcctagagatcgagaccgacgacggccgtagtacttacgtgtgcgagagagtacggggtaaattagtttacgacgttcggttaacccgttcgtttacgaaccgttacggtcggggacccgtaacggggtaacccgttcggg

SEQ ID NO: 391851 - DNA, 578 bp, Homo sapiens
  misc_feature: GZ8MTXP02G1KJV.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaggcttgagtggatgggatggatcagcgcttacaatggtacacaacaaactatgacccacagaacctccaggggccaagtcgtcaccatcgaacccacagacacatccacgagcacgcctacatcggacctgaggagcctagacatctagaccgaacgaccggccgtaggtaacttacgtagtgacgaagagagtacggggaaaattagtttacgacgttacgggttacccttcgtttacgtaccgttaacggtcgggggtaccctaacgggggtaaccctttcggg

SEQ ID NO: 391852 - DNA, 537 bp, Homo sapiens
  misc_feature: GZ8MTXP02F3NDJ.39.81.H04.1.454.CMB.2.raw
  modified_base (365)..(365): a, c, t, g, unknown or other
  modified_base (379)..(379): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcagggcagngtcaccatgaccanagacacatccacgagcacgcctacatcggacctgacgagccagagatctagacgacgacggcgtagtattacgtgtgcgagagagtacggggtaaaattagtttacgacttcggtacccttgttacgactacgtcggggaccaacggggtaccctcgg

SEQ ID NO: 391853 - DNA, 539 bp, Homo sapiens
  misc_feature: GZ8MTXP02GXRMK.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaaatttataaggtttctaaccgggctcgtggggtcccagacagacttcagcggcaggtgggtaagcactgaaattcacactgaaaatcagcagggtgaggctaggaggatgttggggtttatacgtgcatgacgaaggaacacgaacgttggacctccggtaactacgtttgggaccgtaagggggacccaaaggcgtaggagaatacaaaacgaacgtagtgactgacaccatccgtgtcc

SEQ ID NO: 391854 - DNA, 628 bp, Homo sapiens
  misc_feature: GZ8MTXP02FSUI0.39.81.H04.1.454.CMB.2.raw
  modified_base (344)..(344): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaaggcttgagtggatgggatggatcagcgcttacaagtggtacaacaacaaactntgacccaacacgaaacctccaaggggccagacgtcaaccatcgaccacagaccaacacacccagacgacaccggaccctacattacgggacctaggacggaagcccgtaggacgatcgtacggaacgaccgacgggggtacctaggttacttaaccgtggttacggcggaaacggtaggaacgggttacgggggtaaaaattgttttacggtaacgttccgggtttaaccctgttttacgaaccgtttacggcgggggttaccaacgggggtaacccttccggg

SEQ ID NO: 391855 - DNA, 549 bp, Homo sapiens
  misc_feature: GZ8MTXP02JVYO4.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatgaaacactacttgaattggttcagcagaggccaggccaatctccgaaggcgacctaatttataaggtttcaaccggactcgtgggtcccagacagtattccagcgcaggtgggtcaggcactgaattcacactagaaaatcagcgagggtggaggcgtaggaggtagttggttaggggtttattacgtgactagtggacgaaggtacaacacgtcggcccttacgtactacgtttcggaccgtacggggaccaaggcgtaggacgactacgaaacgtaacgtggtaagctacgacaccatcgtcttcc

SEQ ID NO: 391856 - DNA, 522 bp, Homo sapiens
  misc_feature: GZ8MTXP02JU7B6.39.81.H04.1.454.CMB.2.raw
  modified_base (360)..(360): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagcagaggccaggccaatctccaaggcgacctaatttataaggtttcaaccgggctcgtggggtcccagacagacttcagcggcaggtgggtnggcactgaattcacactagaaatcagcgagggtggagcgtaggaggtagtggttaggggtttattacgtgcatgacaaggaacacgactggcctcgtactactttcggcgtacgggaccaagctaggagacgtacaaacgactgcgctcgacaccactctcg

SEQ ID NO: 391857 - DNA, 614 bp, Homo sapiens
  misc_feature: GZ8MTXP02I48I4.39.81.H04.1.454.CMB.2.raw
  modified_base (401)..(401): a, c, t, g, unknown or other
  modified_base (410)..(410): a, c, t, g, unknown or other
  modified_base (519)..(519): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttgagtggatgggatggatcgagcgactttaacaagttggtacaacgaacaaaactatcgacaacaacgaaaccctccgaaggggacaggacgtacaaccctaancgaacccanaacgaacaacaactcccaacgacgccgaaccggaccctaacaacgtcgggaccctggaaggacgccgtaggagatcgagaacgacgaccggtccgtacgtaatttacgngtacgacgagagtaggtaacggggtaaaattacgttttagaccgttacggtaaccctacgtttacgactacggtacgggaccgtacggtaacccg

SEQ ID NO: 391858 - DNA, 574 bp, Homo sapiens
  misc_feature: GZ8MTXP02JKI3E.39.81.H04.1.454.CMB.2.raw
  modified_base (373)..(373): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacaggcccctggacaagggcttggagtggagtgggatggatcgagcgcttacaagtggtacacaacaaactatgaccacacgaacctcgaggcagngtcacatcgaccacagacacacaccacgagcaccgcctacatcgacctagaggacgcctagagatcgtagaaccgaccgacgggtccgtgttaactacgtggtagcggaagaggaaggtacggggtaaattacgtttcgaacgttcggtaccccttaagttcgtaacgtacggttcggggaccgtacgggaacccgttcgg

SEQ ID NO: 391859 - DNA, 543 bp, Homo sapiens
  misc_feature: GZ8MTXP02G5JJA.39.81.H04.1.454.CMB.2.raw
  modified_base (346)..(346): a, c, t, g, unknown or other
  modified_base (368)..(368): a, c, t, g, unknown or other
  modified_base (382)..(382): a, c, t, g, unknown or other
  modified_base (427)..(427): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggggtgcgacacggcccctggacaagggcttgagtggatgggatggatcagcgcttacaagtggtcacaacaaactntgccacagaacctcagggcagngtcacatcgaccanagacacatccagagcacgcctacatggacctgagacgcctggacntctgaaccgacacggcctgtactactgtgcgaagagagtacggggaaaattagttttcgaacgttggttacccttgtttacgactacggtaggggcccaacgggggtaaccttcgg

SEQ ID NO: 391860 - DNA, 545 bp, Homo sapiens
  misc_feature: GZ8MTXP02JLKFW.39.81.H04.1.454.CMB.2.raw
  modified_base (390)..(390): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgataggaaacacctacttgaattggttcagcagaggccaggccaatctaccgaaggcctaccttaatttagtaaacggtttcaaaccggggactcgtcggggtacccaagacagtatcgagcggcaggtgggcaggcacgtgaattcanactagaaatcagcgagggtgagcgtaggaggtagttggttaggggtttatacgtgacagtgacgaaggaacagacgtggcctacgtactacgtttcggacgtaggggaccaggcgtaggagactacgaaacgaacgtgtcgactgacaccattcg

SEQ ID NO: 391861 - DNA, 645 bp, Homo sapiens
  misc_feature: GZ8MTXP02GO1X2.39.81.H04.1.454.CMB.2.raw
  modified_base (342)..(342): a, c, t, g, unknown or other
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactntgaccacagaacctcgaggcagngtcaccatcgaccacagacacactaccacgagccaacggccacgagtacggacctaggacggaacgcccgtagacggtactcgtacggaaccgaaccgaccgggacccgttaggttaactttaccgtaggtacgacggtaaaggaagggtaacggttaaaccgggggtaaaatttacggtttttaacggaaaccgttcgggtttaaccccgttcgttttacggtaacccgtttacgggttacgggggaccccgtaacgggggtaaacccccgtttcgggg

SEQ ID NO: 391862 - DNA, 560 bp, Homo sapiens
  misc_feature: GZ8MTXP02I7JOT.39.81.H04.1.454.CMB.2.raw
  modified_base (366)..(366): a, c, t, g, unknown or other
  modified_base (423)..(423): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacaacaaactatgccacagaacctcagggcagngtcaacatagaccacagacacatccacgagcacgcctacatcgactgagagctgagntctgacgacacggcgtagtactacgtgtgcgtagagacgtacgggggtaaaattacgtttacgtaacgttcgggttacccgttcgtttacggaaccttaacgggtcgggggaccgtaaccggggtaaacccgtcggg

SEQ ID NO: 391863 - DNA, 609 bp, Homo sapiens
  misc_feature: GZ8MTXP02GPSZT.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaggctaccttaaatttataaggtttcaaccgggctcgtcggggtcccagacagtatcagcgcagtggcaggcactgaaattcaacactagaaaatcagcgagggtaggaggcgtaggaggtagttggttaggggtttattacgtagacagtagacgaaaggaacaacgaaccgtcggacccgttaccgtaactacgttttacgggaccggtaacggggtaaccgaacggaccgttagggaacggtaaacgtaccgaaaaaccgtaaccgttagggtaacggtaccgtacggaccaaccgtacttccgttacggtttacc

SEQ ID NO: 391864 - DNA, 553 bp, Homo sapiens
  misc_feature: GZ8MTXP02GSL3Y.39.81.H04.1.454.CMB.2.raw
  modified_base (401)..(401): a, c, t, g, unknown or other
  modified_base (426)..(426): a, c, t, g, unknown or other
  modified_base (453)..(453): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacacaaactatgaccaacagaacctccgaggcagagtcaccatcgaccacagacacactccacgancacgcctacatcggacctgacggancctagagatcagacgaacgacggcgtntacttacgtgtgcgaagagagtacggggaaaattagtttcgaacgttcggttaacccttgtttacgacgtacgtggggacccaacggggtacccgtacgg

SEQ ID NO: 391865 - DNA, 571 bp, Homo sapiens
  misc_feature: GZ8MTXP02H7BE9.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctgtatacattgatggaaacacctacttgaattggttcagcagaggccaggccaatcaccaaggcactaaatttataaggtttctaaccgggactcgtggggtcccagacagtatcgagcggcaggtggtcaggcactgaacttcacactagaaaatcagcgagggtgaggctaggaggtagttgggttaggggtttattacgtgactagtggacgaaaggaacacgacgtacggccttccgtacttacgtttcggaccgtaacgggggaccaaggcgtaggaacgtaacgtaccgaaaacgtacgtggtaacggcgtacgacctaacacttcgttacgttcc

SEQ ID NO: 391866 - DNA, 603 bp, Homo sapiens
  misc_feature: GZ8MTXP02F1JGR.39.81.H04.1.454.CMB.2.raw
  modified_base (498)..(498): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttacactatggtatcagttggtgcgacacggcccctggacgaggcttgagtggatgggatggatcgagcgtacttaacaagtggtacaacaacaaactatcgacacaacgaacctcgacggacagacgtacaaccatacgaaccacaacgacaacacaccgaacgacgaccgacggcctaacgagtacggaccgtggaacggacgcgtacgagactcgacgacgacgacggtccgttagtacgttacgngtacggacggaggtagtaaggttacggggtaaatttacgtttacgtacgttcggttaacccgttacgttacgtacggtacggtacggggaccgtacggtacccgg

SEQ ID NO: 391867 - DNA, 591 bp, Homo sapiens
  misc_feature: GZ8MTXP02JCIC9.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctaccaaaggccgacctaaatttataaggtttctaaaccgggactcgtggggtcccagacagatccagcggcaggtggtcaggcactgaacttcacactagaaaatcagacgaggggtggaggcgtggaggtagttgggtttaggggtttattacgtgcgtagttcgagaaagggaacaacacgtggacccttacggtactacgttttcgggaccgtaacgggggaaccgtaaggtcgtacgggaagtaacgtacgaaaaccgtaacgtaggtcggactacggaccaacctacttacgttacgtttcc

SEQ ID NO: 391868 - DNA, 575 bp, Homo sapiens
  misc_feature: GZ8MTXP02H2ZEI.39.81.H04.1.454.CMB.2.raw
  modified_base (333)..(333): a, c, t, g, unknown or other
  modified_base (369)..(369): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtcctccctgcccgtcacccttggacaggccggcctccatctcctgcaggtctagtcaaagcctcgtatacattgataggaaacacctacttgaattggttcagcagaggccaggccaatcctcgaaggcaccttaaatttagtaaggtttcaacgggacttcgnggggtacccagacagacttcgagcggcaggtgggcngggcatgaattcaacactaagaaactcgagacgagggtggaggcgtaggaggtagttgggtttagggtttattacgtagtcgagtgaacgaaggaacacgacgtacggtacctacgtactacgtttcggaccgtacggggaaccaggacgtaggaacgacgtaacgaaacgacgtggtacgacgtacgacaccgtacttccgtacg

SEQ ID NO: 391869 - DNA, 542 bp, Homo sapiens
  misc_feature: GZ8MTXP02FSTSQ.39.81.H04.1.454.CMB.2.raw
  modified_base (366)..(366): a, c, t, g, unknown or other
  modified_base (381)..(381): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgaccacagaacctcagggcagngtcaccatcgaccanagacacatccacgagcacgccacatcggacctagaggagcctgagatctgacgacgacggccgtgtacttacgtgtgacgagagagtacggggaaattacgtttagacgttcggtaccctcgtttacgacgttacgtcggggaccacggggacccttacgg

SEQ ID NO: 391870 - DNA, 617 bp, Homo sapiens
  misc_feature: GZ8MTXP02JNMQY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaagtggtacacaacaaactatgacccacaacgaaccctccgaaggggcaaggacgtccaaccataccgaccaacagaccacactacccacgacgaccaccggacctacacgtcggacctaggacggacgccgtaggacgtatacgtacggaccgaacgaccgggtccgtagttaacttacgtgtcgacgtaaggaggtaacggtacggggtaaatttagtttacgaaccgttcggttacccttgtttacgtacgttacggtcggggacccgtaacggggtacccgttacgg

SEQ ID NO: 391871 - DNA, 596 bp, Homo sapiens
  misc_feature: GZ8MTXP02HCC8L.39.81.H04.1.454.CMB.2.raw
  modified_base (247)..(247): a, c, t, g, unknown or other
  modified_base (284)..(284): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctcatctcctgcaggtctagtcaaagcctcgtatacattgatggaaacncctattgaattggttcagcagaggccaggccaaatcnccaaaggcacctaaatttataaggtttctaaaccgggacttcgtggggtcccaagacagattccagcgcaggtgggtcaggcatgaaacttcaacaactagaaaatcagacgagggtggaggcgtaggaggtaagtgggtttaggggtttattaacgtgtctagtagacgaaaggaacaaccgacgtaggacccttaccggtaacctacgttttacgggacccgtaacgggggaaacccaaaggtccgtacggaaagacgtaacgaaaacgtaactaggtaacggcgtacgacaaccctatccttgtttacc

SEQ ID NO: 391872 - DNA, 528 bp, Homo sapiens
  misc_feature: GZ8MTXP02IOV4B.39.81.H04.1.454.CMB.2.raw
  modified_base (358)..(358): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaatttataaggtttctaaccgggactcgtggggtcccagacagattcagcggcagtggtcngggcactgattcacactgaaaatcaagcagggtggagctgaggagtgttggggtttattacgtgcatgacaaggaacacgacgtggcctccgtactactttggcctaggggaccaaaggcgtaggagacgtacaaacgaactgtacggtctacggccacgtactctttcg

SEQ ID NO: 391873 - DNA, 550 bp, Homo sapiens
  misc_feature: GZ8MTXP02II6MD.39.81.H04.1.454.CMB.2.raw
  modified_base (275)..(275): a, c, t, g, unknown or other
  modified_base (369)..(369): a, c, t, g, unknown or other
  modified_base (383)..(383): a, c, t, g, unknown or other
  modified_base (423)..(423): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtacacaacaaactatgaccacagaacctcgaggacagngtcacatcgaccanagacacatcccagacgcacgcctacatcggacctggaganccgtagagatcgtagaccgacgaccggcgttgtaacttacgtgtgacgagacgagtacggggtaaaattgtttcgacttcggttacctgtttacgacgttacggtcgggacctacgggaaccttcgg

SEQ ID NO: 391874 - DNA, 649 bp, Homo sapiens
  misc_feature: GZ8MTXP02JJN0T.39.81.H04.1.454.CMB.2.raw
  modified_base (378)..(378): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatacgaacctacctatagtaattggtcagcaggacgccacggaccaatcctaccgacggccgtaccttaaatttaacgtaacggtttaccgtaaccgggtacttcggtacggtccaagacagtactcgagcggngaggtcggtcgaggctacgtagtaagttaccaactacgtaaagtaaaacgtcgaggacggtagggggtacggaggtcgtagggaagggtagtttgggggtttagggtttaactacgtggtactagtacggaacgtaaaggaaccacgtacggtccggtacccttaccggtactttacggttaccggaccgggtacgggaacctaacggcggtaagggactaacgtaaccgaaaacgtccgtaggtacgccgtacgaccgtaactgttaccg

SEQ ID NO: 391875 - DNA, 562 bp, Homo sapiens
  misc_feature: GZ8MTXP02JJFK4.39.81.H04.1.454.CMB.2.raw
  modified_base (275)..(275): a, c, t, g, unknown or other
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttggagtggatgggatggatcgagcgcttacaatggtacacacaaactatgaccacagaacctccagggcagngtcacatgaccacagacacactccacgagcacgcctacagtcggacctgaggacgccgtagagatctagaccgacgaccggccgtagtattacgtgtgcgagaggaagtacgggggaaattagtttacgacgttcggtacccgttcgtttacgtaccgtacggtcggggaccgtacggggtaacccgtcggg

SEQ ID NO: 391876 - DNA, 606 bp, Homo sapiens
  misc_feature: GZ8MTXP02IWLE0.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacacctacttgaattggttcagcagaggccaggccaatctaccaaggcgtacctaatttataaggtttcaaccgggtactcgtcggggtcccagacagacttcagcggcaggttgggcaggcactgaattcacactagaaatcagacgagggtgaggctaggaggtattggttaggggtttattacgttgactagtacgacgaaacggaacacgacgtcggtacccttaccggttaactacggttttacgggacccggtaacgggggtaacccgaaggtaccgtaggtacgtaacgttaaccgaaaaaccgtaaacggtcggtacgggaccgtacggtacccaaccgtaacgtttccg

SEQ ID NO: 391877 - DNA, 560 bp, Homo sapiens
  misc_feature: GZ8MTXP02F7TY4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccgagggcagcgtcaccatcgaccacagacacatcccacgacgcacgcctacatggacctgaggagccgtgagtatcgtaggaccgacgacggtccgtgtacttacgtgtgcgaggagagtacggggtaaaattagtttcgaacgttcggtacccttgtttacgaacgttacgtcggggaccgtaacggggtaacccgttcggg

SEQ ID NO: 391878 - DNA, 602 bp, Homo sapiens
  misc_feature: GZ8MTXP02GINE2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacaggcccctggacgaagggcttgagtggatgggatggatcagcgcttacaatggtacacaacaaactatcgaccacacgaaacctccagggacaagcgtacaccatcgaaccacacgacacactacccacgacgcaacgcctacagtcggacctaggacggacgcctaggagatcgagacgaccgacgggtaccgttagtacttaccgtagtggacgaaggaggtaggttaacggggtaaaatttacgtttacgacgttacggtttaaccccttgtttacgacgttacggtacggggtaccgaacggggtacccgttaccggg

SEQ ID NO: 391879 - DNA, 600 bp, Homo sapiens
  misc_feature: GZ8MTXP02HFPQB.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagaggccaggccaatctccaaaggctacctaaatttataaggtttctaaccggacttcgtggggtacccagacagattccagcggcaggtggtcaggcactgaaacttcaactactagaaaactcagcgagggtagggaggcgtagaggtagttggtttaggggtttattacgtgactagtgtacgaaaggaacgaacacgtcggacccttaccgtacgtacgttttacgggaccgtaacggggaccgaaacggtcgtagggaacgaacgtaacgtaaaacgaacgttacggtcggtacgtacgaccgtacctacgttacctagtttccc

SEQ ID NO: 391880 - DNA, 507 bp, Homo sapiens
  misc_feature: GZ8MTXP02IRLCL.39.81.H04.1.454.CMB.2.raw
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggtttcagcagaggccaggccaatctccaaggcgcctaatttataaggtttctaaccgggactctggggtcccagacagattcagcgcagtggtcaggcactgaattcacactagaaaatcagcaggtggagctgaggatgttggggttatacgtgctatgtacaaggaacacacgtcggcctcgtacactttggcgtaggggaccaagctggagatacgaaacgactagtgctcgcaccatctgttc

SEQ ID NO: 391881 - DNA, 569 bp, Homo sapiens
  misc_feature: GZ8MTXP02G670X.39.81.H04.1.454.CMB.2.raw
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccgaggcagngtcacatcgaccacagacacatacccacgagcaccggacctacagtcggaccctagacggagccgtagacgtatcgtaggaccgacgaccgggaccgtagtacgttacgtgtgacggtagagagtacggggtaaattacgtttacgacgttcggttaaccctgtttacgacgttacggtcggggaccacggggtaaccctcgg

SEQ ID NO: 391882 - DNA, 531 bp, Homo sapiens
  misc_feature: GZ8MTXP02GSMS9.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggttcagcagagcaggccaatctccaaggcactaattataaggtttctaacgggctcgtggggtccagacagatcagcggcagtgggtcaggcacgtagattcacactagaaaatcagcagggtggaggctgaaggagtggttaggggtttattacgtgtactagtagacgaaggaacacgactggcctaccgtactacgtttcggaccgaggggaccaagcgtaggagaactacgaaaacgtaacgtgacgtacgtgacaccattcg

SEQ ID NO: 391883 - DNA, 566 bp, Homo sapiens
  misc_feature: GZ8MTXP02IAMGR.39.81.H04.1.454.CMB.2.raw
  modified_base (253)..(253): a, c, t, g, unknown or other
  modified_base (394)..(394): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacnctacttgaattggttcagcagaggccaggccaatctccaaggcacctaatttagtaaggtttctaacggtactcgtcgggtaccgagacagattcgagcggcaggtgggtcgaggcactagaattacacactacgtaaaanaacacgagaggaggaggagtagaggtagttaggttagggtttagttagttagtagtagtagtagaacgaacgaacgacgtacgtacgtaccgtacgtacgttacgtacgtacggacgacgacgtacgacgacgtaacgaacgaacgtacgtacgtacgacgacgactactcg

SEQ ID NO: 391884 - DNA, 595 bp, Homo sapiens
  misc_feature: GZ8MTXP02GPOXO.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgataggaaaacacctattgaattggttcagcagacggccaggccaatctccgaaaggccgtaccttaaatttagtaaggtttctaaccgggactcgtcggggtacccagacagactcgagcggcaggtggtcagggcacgtgaaacttcaactactagaaaatcgaagcgaaggggtggaggcgtaggaggtagttgggtttaggggtttaattacgttgacagttagacgaaacgggaacacgacgtcggacccttaccgtacttacgtttcgggaccgaacggggacctaaagcgtaggagtaactaccgaaaacggtaacgtggtcggacgtcgaccactactacgtttcg

SEQ ID NO: 391885 - DNA, 678 bp, Homo sapiens
  misc_feature: GZ8MTXP02GWRL0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtcttaacaagttcggtaccaacgaaactaaaactagtcgaccccaacaacgaaccctccgaggggaccaaggacgtaccaacccagtaccgaacccaacgaacgaaccaacactacccgaacgacgaccgaacccggaccctaacgacgtaccggacgagggaacgaccgtacgtagacgtactacgacgaccgacgtccggtacgttagtaacgttgtacggacgacggtaagacgggttaaacgggtaaacggttaaagtttacggttacgtaccggtttacccgttaccgtttcgttaacgtaaaccggttccggggaccggtaacccggtaacccggtaccggtttacccgg

SEQ ID NO: 391886 - DNA, 675 bp, Homo sapiens
  misc_feature: GZ8MTXP02IBHBK.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaacgcctgtatacattgataggaaacctacctactgtaattggttcagcagacggccaggaccaatcctaccgaaaggcgtaccttaaatttagtaaacggttttcgtaaaccggggtactcgtacggggtacccaggactaggtacttacgacggcgggacgtagggttcggggtccaaggggcctaaccgttaggtaaactttccgaaacctaaccgtaaagtaaaaacgtccgaaaggacgaagggggtagggaggacgttaggaagggtagtttaggggtttaggggtttatttacgtggtacgtaagtagacgaaaggaaccaacgtacgtcgggtacccttaccgtacttacgtttacggaccgaaggggaccaaaggtccgtaggaacgtacgtaacaaaacggtaacgtcggtacggacctaggaccctaacacgttcccg

SEQ ID NO: 391887 - DNA, 649 bp, Homo sapiens
  misc_feature: GZ8MTXP02INYND.39.81.H04.1.454.CMB.2.raw
  modified_base (216)..(216): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctnagtgaaggtctcctgcaaggcttctggttactacctttacaactatggtatcagttgggtgcgacgacggcccctaggaacgaagggtcttggagtggagtggggatggatcgagcgcttaacaatggtacacaacaaaactatgaccaacacgaacctccgagggacagacgtcaaccatacgaacccacaaagaccaactacacccaacgacgccaaaccgggacccttaacgacgtacggggaaccctaggaacgggacgacccgttaggaacggaattcgtacgggaaccgacgaaccgggccgttagtaacgttacgtgtagacgaggaacggtagtaacggggtaaaattagtttacgaacgttacggttacccttaacgtttacgaaccgttacggacggggtacccgtaacgggtaacccgtcgg

SEQ ID NO: 391888 - DNA, 576 bp, Homo sapiens
  misc_feature: GZ8MTXP02FSV2S.39.81.H04.1.454.CMB.2.raw
  modified_base (370)..(370): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacacgaaacctccgagggcaagngtcaccatcgaccacagacacactccacgagcacgactacagtcgacctgaggacgccgtagaagatcgtagaaccgacgaccggtccgtagttacttacgtgtgacgaaggacgtaggtacgggggtaaaatttagttttacgaacgttcggttaccctcgtttacgacgttacgtgggggaccgtacggggaacccctttcggg

SEQ ID NO: 391889 - DNA, 531 bp, Homo sapiens
  misc_feature: GZ8MTXP02F3S6U.39.81.H04.1.454.CMB.2.raw
  modified_base (276)..(276): a, c, t, g, unknown or other
  modified_base (364)..(364): a, c, t, g, unknown or other
  modified_base (379)..(379): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggctgagtggatgggatggatcagcgcttacatggtcacacaaactatgccacagaacctcagggcagngtcaccatcgaccanagacacatccacgagcacgcctacatcggacctagaggagcctgagatcagacacgacggctgtactacgtgtgcgagagagtcggggtaaatagtttacgaacgtggtaccctgtttacgacgtacgtcgggaccgtacgggtaccctcgg

SEQ ID NO: 391890 - DNA, 506 bp, Homo sapiens
  misc_feature: GZ8MTXP02JIGTB.39.81.H04.1.454.CMB.2.raw
  modified_base (302)..(302): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctatgaattggttcagcagagccaggccaatctcaagcgcctaatttanaaggtttctaacggactctggggtccagacagatcagcgcagtgggtcaggcatgaattcacactagaaaatcaagcgaggtggagctgagatgttggggttattactgcagtgacaaaggacacactcggctacgtactactttggaccaggggacctaaggctaggagaactacaaaacgaatgtacgcgtgacaccattcc

SEQ ID NO: 391891 - DNA, 592 bp, Homo sapiens
  misc_feature: GZ8MTXP02GXTFX.39.81.H04.1.454.CMB.2.raw
  modified_base (362)..(362): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccgaaggcgaccttaatttataaggtttctaaccgggactcgtggggtcccagacagacttcagcgcaggtggtcngggcactgaattcacactagaaaatcagcgaggggtaggaggcgtaggaggtagttggtttagggggtttattacgtgtactagtgtacgaaagggaacacgtacgtcggaccctaccgtacgtacgttttcgggacccggtaacgggggaacccgaaggtaccgtagggaacgtacgttaacgaaaacgtaacgtggtacggacgtacggaccacctaactcgtttacg

SEQ ID NO: 391892 - DNA, 572 bp, Homo sapiens
  misc_feature: GZ8MTXP02HJ4S9.39.81.H04.1.454.CMB.2.raw
  modified_base (376)..(376): a, c, t, g, unknown or other
  modified_base (398)..(398): a, c, t, g, unknown or other
  modified_base (436)..(436): a, c, t, g, unknown or other
  modified_base (440)..(440): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccctttaccaactatggtatcgagttgggtgcgacacggcccctggacaagggcttgagtggatgggatggatcgagcgcttacaagtggtacaacaacaaactatgacccacagaaccctcgaggcagngtcacatcgaccacagacacanccacgacgcacggcctacatcggacctgagcgctgagntcgngacacgacggtcgtagtatacgtgtgacggtagacggtagtacggggtaaaatttcgtttacgaacgtttcggtaacccttgtttacggaaccgttcggtacggggtacccgtaacggggtaaccccgtcgg

SEQ ID NO: 391893 - DNA, 583 bp, Homo sapiens
  misc_feature: GZ8MTXP02GJFG3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacgacaaactatgaccacagaacctcgagggcagagtcaccatcgaccacagacacataccacgagcacggacctacatcggacctgacgggacgcctagagatacgtgaacgacgacggaccgtgtaacgttactgtgacgagaggtaagtacgggggtaaaattagtttacggtacgttacgggttacccttcgtttacggtaacgttacggtacgggggtacctaacgggggtaaaccccttcggg

SEQ ID NO: 391894 - DNA, 696 bp, Homo sapiens
  misc_feature: GZ8MTXP02GS83N.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacgaagggcttgagtggatgggatggatcagcgcttacagtggtacacaacaaactatgaccacagaacctccgagggacagagtaccaaccatacgaacccaacgacgaacctaacactacccgaacgacgaccgaacccggaccctaacacgtacgggaaccctagggaaacgggacgcccgtaggaacgtacgttaccgtacgggaaccgaacccgaaccggggtcccgttaggttaacgtttaaccgtggtacggacggaaggtaaggtaacggttaaacgggggttaaaatttaggttttacggaaccgtttaccggggttaacccctttaacggtttacggtaaacccgtttacgggtaccgggggtaacccgtaaccgggggtaaaccccgtttccgggg

SEQ ID NO: 391895 - DNA, 527 bp, Homo sapiens
  misc_feature: GZ8MTXP02FS1GC.39.81.H04.1.454.CMB.2.raw
  modified_base (509)..(509): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgcctaatttataaggtttctaaccggactcgtggggtcccagacagattccagcgcagtgggtcaggcactgaattcacactagaaaatcagcgaggggtggaggctggaggtagttggtttagggggtttattacgtggcatgacaaggtaacacacgtggcctccgtactacgtttggccgaggggaccaagctaggagactacaaacgactgngctacgcaccatctgttc

SEQ ID NO: 391896 - DNA, 567 bp, Homo sapiens
  misc_feature: GZ8MTXP02GSYT6.39.81.H04.1.454.CMB.2.raw
  modified_base (381)..(381): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaaacactacttgaattggttcagcagagccaggccaatcacaagcacctaatttataaggtttactaaccgggactcgtggggtccagacagatccagcgcagtggtcaggcactgaattcacactagaaaatcacgngagggtggaggcgtaggaggtagtaggtttgggtttaattagtagactagtgacgaaaggaacacaacgtcgaccgtaccgtaactaccgtttaggacccgaaggggaacccaaggacgtacgggaacgtaagtaaccgaaaacgtaacgtggtaaggactacggaccaccgatccttagttaccc

SEQ ID NO: 391897 - DNA, 552 bp, Homo sapiens
  misc_feature: GZ8MTXP02JX3KW.39.81.H04.1.454.CMB.2.raw
  modified_base (342)..(342): a, c, t, g, unknown or other
  modified_base (364)..(364): a, c, t, g, unknown or other
  modified_base (377)..(377): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactntgccacagaacctcagggcagngtcacatgaccanagacacatccacgagcacggcctacatcggacctgaggagcctgacgatctgacgacacggccgtgtacttactgtgcgagagagtacggggaaattagttttacgacgttacgggttaccccttcgtttacgaaccgttacggtcgggggacccaacgggggtaacccctcggg

SEQ ID NO: 391898 - DNA, 563 bp, Homo sapiens
  misc_feature: GZ8MTXP02JZMPK.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaactatgaccacagaaccctccgagggcagagtcaccatcgaaccacagaccacactacccacgacgcacggcctacagtcggacctgaggacgcctgagatacgcgacgacgacggaccgtagtacgttactgtgcgagagagtacggggtaaattagtttacgacgttcggttacccttcgtttcgacgttacgtcggggaccgtacggggtaacccgttcgg

SEQ ID NO: 391899 - DNA, 635 bp, Homo sapiens
  misc_feature: GZ8MTXP02F19T9.39.81.H04.1.454.CMB.2.raw
  modified_base (371)..(371): a, c, t, g, unknown or other
  modified_base (403)..(403): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactatcgaccacagaacctccgagggccagngtcaccatacgaccacagacacatccacgacncacgacctacatcggacctaggacggacgcctaggaacgattccaggaccgaaccgaccgggacccgttaggttaacttaccgtagtacgaccggtaaggtacggtaaaggttaccgggggtaaaatttacggtttttacgaaccgttcggggttaacccccttaagtttttacggaaaccgtttaccggttacgggggacccgtaaacgggggtaaccccgtttaccgggg

SEQ ID NO: 391900 - DNA, 509 bp, Homo sapiens
  misc_feature: GZ8MTXP02FEW5Z.39.81.H04.1.454.CMB.2.raw
  modified_base (428)..(428): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaatggtttcagcagaggccaggccaatctccaaggcgcctaatttataaggtttctaacccgggactcgtggggtcccagacagacttcagcggcagtggggtcaggcactgaattcacactgaaaatcagcagggtggagctgaggatgttggggtttattactgcatgnaaggaacacactggcctccgtacactttgccgacggggacagactggagagtacaaacgaacaagtggactgcacatctcg

SEQ ID NO: 391901 - DNA, 533 bp, Homo sapiens
  misc_feature: GZ8MTXP02H62YT.39.81.H04.1.454.CMB.2.raw
  modified_base (447)..(447): a, c, t, g, unknown or other
  modified_base (509)..(509): a, c, t, g, unknown or other
tcagtcgcactagtcacgaccggtgctcgatttagtagtgtagattcgcggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaaatctccaaaggcgacctaaatttataaaggtttctaaaccgggatctggggtcccagacagatccagcgcagtggcaggcactgaaattcaacactagaaaatcaagcagggtggaaggctagaggatggttaggggtttattacgtgcatgacaaagggaacanaactggcctacgtactactttggaccaaggggaccaaagctaggaagactacgaaacgaacngtaaggctggacaccatctacgtc

SEQ ID NO: 391902 - DNA, 581 bp, Homo sapiens
  misc_feature: GZ8MTXP02JM69L.39.81.H04.1.454.CMB.2.raw
  modified_base (368)..(368): a, c, t, g, unknown or other
  modified_base (381)..(381): a, c, t, g, unknown or other
  modified_base (396)..(396): a, c, t, g, unknown or other
  modified_base (419)..(419): a, c, t, g, unknown or other
  modified_base (441)..(441): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacaacaaactatgaccacagaacctcagggcagngtcacatcgacanagacacactccacgngctacggcctacagtcggaaccnggaggacgccgtggacgatcgngaaccgacgaccggcggttgtaacgtttaccgtgtagacggaagaggaacggttacgggggaaaatttacgttttaggaacttcgggttacccctgtttacggacgtacggtcgggggaccgaacggggtaccccttggg

SEQ ID NO: 391903 - DNA, 518 bp, Homo sapiens
  misc_feature: GZ8MTXP02ITVKH.39.81.H04.1.454.CMB.2.raw
  modified_base (440)..(440): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatctcaaggcgcctaatttataggtttcaaccggactcgtgggtcccagacagattccagcgcagtggtcaggcactgaattcacactagaaaatcagcgagggtggaggcgtgaggtagttggttaggggtttatacgtgcatgacaaggacacacgngcctcgtactacgtttcggcagggaccagcgtaggacgatacgaaaacgacgtagtaagctagacacactctacgttc

SEQ ID NO: 391904 - DNA, 619 bp, Homo sapiens
  misc_feature: GZ8MTXP02HOLJC.39.81.H04.1.454.CMB.2.raw
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggggtgcgacacggcccctggacaagggcttgagtggatgggatggatcagcgctaacatggtcacaacaaactatgacccacagaacctccgaggcagacgtcacatcgaccacagacacanccacgacgcaaccggactacagtcggacctagagggacgaccgtagagtactcgtacggaaccgaaccgaccgggtccgttagtaactttacgtggtacgacggtaacggaggtaaggtacgggggtaaaatttagttttacggacgtttaccgggtaaccctttcgtttacgtaaccgtttaccgggtacgggggtacccgtacgggggtaaaccccgtttcgggg

SEQ ID NO: 391905 - DNA, 623 bp, Homo sapiens
  misc_feature: GZ8MTXP02H7SWV.39.81.H04.1.454.CMB.2.raw
  modified_base (357)..(357): a, c, t, g, unknown or other
  modified_base (408)..(408): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctgggacaaggggcttggagtggagtgggatggatcgagcgacttacaagtcggtacacgaacaaaactntgacccaacacgaaccctcgagggcagacgtaccaccatacgaaccacganaccaacactacccacgacgccgaccggacctaacagtacggacccgtggaaggacgtcctaggacgtatcgaggaaccgacgaccggtaccgtagttacgttacgtggtcgacgtagacggtaggtaacgggtaaattcgtttacgacgttaccggttacccttcgtttacgaaccgttacggtaccggggaccgtacggggtaacccttccggg

SEQ ID NO: 391906 - DNA, 654 bp, Homo sapiens
  misc_feature: GZ8MTXP02FZMVK.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggcccctggacaagggcttggagtggatgggatggatcagcgacttacaatggtacacacaaaactatcgaccaacacgaaacctccgaaggggacaaggacgtcaaccgaatacgaacccaacaagaaccaacaactacccgaaacgaacgaccgaacccggaccctaaccaagttacgggaaccctaggaacgggacgacctaggaagacgtccgtaggaaccgaccgacgggcccgtagttaacgttacgtggtacgacggagtaggaaggttacggggtaaaattagttttacgacgttacggttaccccttcgttttacggaacccgtacggtacgggggacccgtaacgggggtaaccccttacggg

SEQ ID NO: 391907 - DNA, 544 bp, Homo sapiens
  misc_feature: GZ8MTXP02HJPXP.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgacctaatttataaggttctaacgggactcgtggggtcccagacagacttcagcgcagtggcaggcactgattcacactgaaaatcaagcagggtggaggctggaggtagttggttaggggtttattacgtgcagttgacgaaaggaacacgaacgtgacccgtcgtactacgttttggacgtaacggggtaccaaaggcgtagggagacgtacgaaaacgtaacgtgtcggactacgacacctaatctcg

SEQ ID NO: 391908 - DNA, 588 bp, Homo sapiens
  misc_feature: GZ8MTXP02HKMY1.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctcgtatacattgataggaaactacctacttgaattggttcagcagagccagccaatcacagcactaatttatagttcaacggctcgtcgggtccagacagtatccgagcgacgtaggtggtacaggctactagtaaattccaactaacaagaaaactcgagacggagggtaggaggcgtaggaggtagttagggtttagggtttagttacgtaggtactaagtagtaacgaaacggaacacgtacgtacggtacccttacgtacgttacgtttacggaccggtaacggggaaccaggtcgaggaacgtaacgtaacgaaacgtaacgtcgaagtacgtacgacacctatcttacgttcc

SEQ ID NO: 391909 - DNA, 636 bp, Homo sapiens
  misc_feature: GZ8MTXP02JAKRE.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacacggcccctggacaagggcttggagtggagtgggatggatcgagcgcttacaagtggtacaacaacaaactatcgaccacaacgaacctccgaagggccaagcgtcaccatcgaaccacacgacaacactacccgagacgccgaacggccctaacagtacggacctaggaacggacgccgtagacgtacgtcgtaggaaccgaccgaccgggtccgttagttacttaccgtggtacggacggaaggacggtaaggttaacgggggtaaaatttacggttttacgaccggtttacgttacccgttcgtttacggaacgttacgggtcggggtacccgaacggggtaacccgtttccggg

SEQ ID NO: 391910 - DNA, 699 bp, Homo sapiens
  misc_feature: GZ8MTXP02JSCIW.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgtaggttgggtgcgacgacggcccctggacgaagggcttggaggtggagtgggatggatcgagcgtacttacaagtcggtacaaccaactaaaactatcgaccacgaacgaaccctcgaggcagacgtaccaaccagtacgaaccacgaacacaaccatacccgaacgacgaccgaccggacctaacgagtacggaccgtaggacggacgccgtaggacgtacttacgacggaacccgaccgtaccgggtcccgttaggttaactttaccgtgggtacgacgggtaacggtaacggtaggttaaaccgggggttaaaatttacggtttttaacggtaaccgtttacccggtttaacccgtttcgttttaacggtaacccgttaaccggggttacgggggaccccgtaaaccgggggtaaccccgtttaccgggg

SEQ ID NO: 391911 - DNA, 599 bp, Homo sapiens
  misc_feature: GZ8MTXP02HYUIZ.39.81.H04.1.454.CMB.2.raw
  modified_base (281)..(281): a, c, t, g, unknown or other
  modified_base (319)..(319): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgataggaaacacctatgaattggttcagcagagccaggccaanctacaaggcactaatttataagttcaacgggacttcgnggggtccagacagacttacgagcggcaggtggcaggcatagaattcacaactagaaaatcgagacgagggtggaggcgtaggaggtagttggtttaggggtttattacgttgacgtagttaggacgaaacgggaacaacgacgttacggacccttaccgttaacgtaccgttttcggaacccggtacggggaaacccgtaaggtaccgtagggaaggtaactaacggaaaacgtaaccgttaaggtacggactacggacctacccgtaatttaccggtcg

SEQ ID NO: 391912 - DNA, 574 bp, Homo sapiens
  misc_feature: GZ8MTXP02HT88T.39.81.H04.1.454.CMB.2.raw
  modified_base (353)..(353): a, c, t, g, unknown or other
tcagtcgcactagtcacgaccggtgctcgatttagtagtgtagattcgcgggggatcaggactcctcagttcaccttctcacaatgaggctcccttctcagctcctggggctgctaatgctctgggtcccaggatccagtggggatgttgtgatgactcagtctccagtctccctgcccgtcacccttggacagccggcctccatctcctgcaggtctagtcaaagctcgtatacattgatggaaacactacttgaattgttcagcagagcaggccaatctcaaggcgcctaatttataaggttctaaccggactcgtgggtccagacagatcacgcgcaggtgggtcaggcncgtgaacttcacactagaaaatcagcgagggtggaggcgtgaggtagttggtttaggggttaattacgtgacgtagtgacgaaaggaacacgacgtcggcctaccgtacgtacgtttcggaccgtaacgggggaaccaaggtaccgtagggaaacgtactaacgaaaacgtaaacgtggtacgggaacctcggacctacctacgtacctcgttccttaccg

SEQ ID NO: 391913 - DNA, 653 bp, Homo sapiens
  misc_feature: GZ8MTXP02FQVXW.39.81.H04.1.454.CMB.2.raw
  modified_base (350)..(350): a, c, t, g, unknown or other
  modified_base (363)..(363): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgataggaaacacctacttgtaattggtttagcagaggccaggccaatctccaaggcacctaatttataaggtttctaaccggactcgtggggtacccagacagatccagcgnagtggtcaggcangtaatcacactagaaaatcgagacgaggggtggaggcgtaggaggtagttgggtttaggggtttaatacgttgactaagtacggacgtaaacgggaacaccgtaaccgtcgggtacccttacccggttaactaccggtttttacgggaccccggtaaaggggggtaaccctaaaggggtaccgttaggggaaaacggtaacgttaaacccgaaaaaacgggtaccgttaggggttaacggggaccttacggaacccctaacccgttaatttaccgtttacggtttacccc

SEQ ID NO: 391914 - DNA, 576 bp, Homo sapiens
  misc_feature: GZ8MTXP02JZ46S.39.81.H04.1.454.CMB.2.raw
  modified_base (344)..(344): a, c, t, g, unknown or other
  modified_base (369)..(369): a, c, t, g, unknown or other
  modified_base (434)..(434): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcagcgcttacaatggtcacacaaactntcgaccacagaacctcgagggcagngtcacatcgaccacacgcacactccacgacgacaccggcctacagtcggacctgagagcctgagntcgagacgacacggcgtagtattacgtgtacgacgtaggaggaggtacgggggtaaatttacgtttacggaacgttcgggttaccccttgttttacgaaccgtttacgggcggggtacccgtacgggggtaacccttcgggg

SEQ ID NO: 391915 - DNA, 542 bp, Homo sapiens
  misc_feature: GZ8MTXP02JV5S6.39.81.H04.1.454.CMB.2.raw
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgccacagaacctcagggcagngtcaccatcgaccacagacacatccacgacgcacgctacatcggacctgacggagcctagagatctgacgacgacggccgtagtacttactgtgcgagagagtacggggaaattacgtttagacgttcggtaccctgtttcgacgttacgtcgggaccgacggggtacccttcggg

SEQ ID NO: 391916 - DNA, 638 bp, Homo sapiens
  misc_feature: GZ8MTXP02FXI4C.39.81.H04.1.454.CMB.2.raw
  modified_base (287)..(287): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctattgaattggttcagcagaggccaggccaatcncaagcactaatttataaggttcaacgggactcgtgggtccagacagacttcagcgcaggtgggtcagggcacgtagaaattcgaacactagaaaaactcgaagacgaaggggtggaagggtacgtaggaagggtagttgggtttagggggttttaactttaacgtggtacgtagttacggaacgaaaagggaaaccaacctacggtacgggtaccctttaaccggttaccgttaacggttttccggggacccgtaacgggggaacccgtaaaggccggtagggaaacgtaacgttaaccgaaaacgtaaacgtcggtacggtacgtacgactaacccgagttacgtttacg

SEQ ID NO: 391917 - DNA, 563 bp, Homo sapiens
  misc_feature: GZ8MTXP02H65C5.39.81.H04.1.454.CMB.2.raw
  modified_base (267)..(267): a, c, t, g, unknown or other
  modified_base (325)..(325): a, c, t, g, unknown or other
  modified_base (557)..(557): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggatgttgtgatgactcagtctccagtctccctgcccgtcacccttggacagccggcctccatctcctgcaggtctagtcaaagcctcgtatacattgataggaaactactatgaattggttnagcagagccagcaatcaccgaaggcaccttaaatttagtaacggtttctaaaccgggnttcgtcgggtacccagacagtactcgagcggctaggtcgggtcagggcacgtagtaacttccaactaactagaaaatcgagacgaggggtggaggtacgtagggagtagttagggtttgggttattacgtgacagttagacgaaaggacacacgtcggtcctacgttactacgtttcgggaccgagggacaagcgtaggacactaacgaaagacgtggacgctacgacactntacgtc

SEQ ID NO: 391918 - DNA, 582 bp, Homo sapiens
  misc_feature: GZ8MTXP02H2F6J.39.81.H04.1.454.CMB.2.raw
  modified_base (270)..(270): a, c, t, g, unknown or other
  modified_base (332)..(332): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctcctgcccgtcacccttggacacgccggcctccatctcctgcaggtctagtacaaagcctagtatacattgatagaaacactatgaattgtcagcagngcagcatcacagcactaattataaggttacacggctcgtgggtaccagacagactcgagcgntaggtggacaggcaagtagtaacttccaacgaactaagaaaactacgagacgagggtagggaggcgtaggagggtaagttagggtttagggtttaattacgtagtacgtagttagaacgaaagggaactaacgacgtacggtaccctacgtaccgttacgtttacggacgtacgggaaactacggacgtaggaacgtacgtaacgaaacgtaacgtaaggtacggacgtacgacgtacctacttacgtcg

SEQ ID NO: 391919 - DNA, 569 bp, Homo sapiens
  misc_feature: GZ8MTXP02IJCF6.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgacttacaatggtcacacaaactatgccacagaacctcgagggcagngtcacatcgaccacagacacatcccacgacgcacggcctacactcggacctgaggacgcctagagatcgtgaccgacgacggccgtagtacttatgtgcgagagagtacggggtaaattacgtttacgaacgttcggttaacccgttcgtttacgaaccgttacggtacgggggtacccgtaacgggggtaacccgttcggg

SEQ ID NO: 391920 - DNA, 586 bp, Homo sapiens
  misc_feature: GZ8MTXP02IWS4Q.39.81.H04.1.454.CMB.2.raw
  modified_base (400)..(400): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctccagtctccctgcccgtcacccttggacagccgcctccatctcctgcaggtctagtcaaagcctcgtatacattgatggaaacacctacttgaattggttacagcagacggccaggccaaatctaccaaaggcaccttaaatttataaaggtttctaaaccgggactcgtaggggtcccagacagatccagcgcagtggcaggcactgaaattcaacactagaaaatcagcgagggnggaggcgtagaggagttggtttggggttattagtgcagtagacgaaaggaacaacacgtcggaccgtaccgttaacgtacgtttacggaccgtaagggggaacccaaaaggccgtacgggaagaacgtaacgaaaaaccgtaagtacggttaaggtaccgtacgaccaacctactacttacgtacc

SEQ ID NO: 391921 - DNA, 562 bp, Homo sapiens
  misc_feature: GZ8MTXP02GVDDC.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatctcaaggcacctaaatttataaggtttctaaaccgggctcgtggggtcccagacagattcagcggcaggtgggtcaggcacgtgaacttcacactagaaaatcagcgagggtggagctggagtagtggttaggggtttattagtgacgagtgacgaaaggaacacgacgttaggcccttccgtaacgtacgttttcgggacccgtagggggaacccaaggtccgtacggagtactacgaaaacgaacgtggtacggactacggacaccgtattccg

SEQ ID NO: 391922 - DNA, 663 bp, Homo sapiens
  misc_feature: GZ8MTXP02HHA0W.39.81.H04.1.454.CMB.2.raw
  modified_base (352)..(352): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagatggtacagtctggagctgagatgacgaagcctggggcctcagtgaaggtctcctgcaaggcttctggttacacctttaccaactatggtatcagttgggtgcgacacggcccctggacaaggcttgagtggatgggatggatcgagcgacttacgaagtcggtacaacgaacaaactntacgacccaacacgaaccctccgagggaccaagacgtaccaaccagtacgaacccaacgaacgaaccctaacactacccgaacgacgaccgaaccggacctacagtacggacctggaacgacgcctagacgtacttcgacgaaccgaacgaccgggtaccggttagttaacgttaccgtggtacgacggaaaggtacggtaaagggtaaccggggttaaaatttacggtttacgtaacgttccggttaacccttaagtttaccgaacgttaccgggtacggggacccgtaaccggggtaacccgtttcggg

SEQ ID NO: 391923 - DNA, 627 bp, Homo sapiens
  misc_feature: GZ8MTXP02JGBWE.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatcctcctgcaggtctagtacaaagcctacgtatacattgatacggaaacttacctattgaattggttcagcagacgccaggccaatctacaggctacttaatttagtaaggtttcaaccggtctcgtcggggtacccagacagtactccgagcgcaggtcggacaggctactagaacttcaactactaagaaaactcgagacgtaggggtaggaggtacgtaggaggtagttggggtttaggggttattacgtgactagtacggtaacgaaaggaaccacgtacggtcggtacccttaccgttacttaccggtttcgggaaccggtacggggaacccgtaaggtcggtaaggaagtaaccgtaacgaaaaccggtacgtacggtaacggtactacggacctaaccgtacttcgtacgtttcc

SEQ ID NO: 391924 - DNA, 701 bp, Homo sapiens
  misc_feature: GZ8MTXP02HZMQN.39.81.H04.1.454.CMB.2.raw
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgaaggtctctgcaaggcttctggttacaccttacaactatggtatcagttgggtgcgacgacggcccctggaaccgaagggcttggaggtggagtgggatggatcgagcgtacttaacgaagttggtaccaacgaaacctaaaactagtacgacccaacgaaacgaaacccctccgaaggggacaacgggacgtacccaaacctacgtaccggaaacccaacgaaacgaaccaaaccacgtacccgaaacgacgacccgaaccggtaccctaacgacgtacgggaacccgttaggaacgggacgtacccgtaggaaggtactacgtacggaccgaacgaacccgggccggttagtactttacgtggtacgacgaggaagtaggttaaacggggtaaaattgttttacggaccgtttacggttaacccctttgttacggtaaccgttacgggttcggggaccccgtaacggggtaaccccgtcgg

SEQ ID NO: 391925 - DNA, 664 bp, Homo sapiens
  misc_feature: GZ8MTXP02I1HWB.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacgaatggtacacacaaactatgccacacgaacctccgagggcagacgtcaaccatcgaaccacaacgaaccacaactcccaacggacgaccaaccggccctaacagtcgggaacctggaacggtacgacccgtaggaagtacgttccgaggaaaccgaaccgacgggtccgttaagttaacgtttaccgtggtacggacggtaaggaacggtacggtaacgggggttaaaatttacgtttttacggaacgtttccggggtttaacccccttcggttttacggaaccgtttaaccgggtcgggggtaccccgtaacgggggtaaaccccgtttccgggg

SEQ ID NO: 391926 - DNA, 535 bp, Homo sapiens
  misc_feature: GZ8MTXP02G1MH5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaaactatgaccacagaacctccgagggcaagcgtcaccatcgaccacagacacatacccacgagccacggacctacatcggacctgaggagccgtgagatcgtagacgacgacggccgtgtactactgtgcgagagagtacggggtaaatagtttgactggtacctgttgactacgtcgggacacgggtaccctgg

SEQ ID NO: 391927 - DNA, 555 bp, Homo sapiens
  misc_feature: GZ8MTXP02G3PIN.39.81.H04.1.454.CMB.2.raw
  modified_base (346)..(346): a, c, t, g, unknown or other
  modified_base (356)..(356): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactactgaattggttcagcagagccaggccaatctccaaggctacctaatttagtaggtttactaacggctcgtgggtcccagacagatcagcgnaggtgggtcnggcacgtagaacttcaacactagaaatcgagcgagggtggaggcgtagagggtagttagggttaggggtttaatcgttaggactagtagacgaaaggaaccacgacgtcggtccctaccgtacgtacgtttggaccgacggggtacacggcgtagacgactaccgaaacgaacgtggtacgcgtagaccaacgcttacg

SEQ ID NO: 391928 - DNA, 655 bp, Homo sapiens
  misc_feature: GZ8MTXP02IR5BS.39.81.H04.1.454.CMB.2.raw
  modified_base (336)..(336): a, c, t, g, unknown or other
  modified_base (345)..(345): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggaccaaggcttgagtggatgggatggatcgagcgcttacaatggtaccncaacaactngaccacacgacctcgaggcagacgtccaactatgaaccacaagaccaacactacccaacgacgcaaccggccctaacacgtacggacctagggaacgggacgtccgtaggacgtatacgtacggaacggaaccgaccgggtaccggtacgttaacgttacgttacgtacggtacggaacggaacggtaacggtaacggggttaaaacggttaaacgttttacgttaccgttaccggtttacccgttaaccgtttacggttaaccgttaccggtaccggggtacccggtaaccggggtaacccggtaccgg

SEQ ID NO: 391929 - DNA, 646 bp, Homo sapiens
  misc_feature: GZ8MTXP02GPW3G.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttctggttacacctttaccaactatggtatctaggttggtgcgacaggcccctggacaaggcttgagtggatgggatggatcgagcgtactacgaatggtacaacaacaaactatacgacaacgaacgaaaccctccgaaggggccagggtacgtaccaaaccgtagtaccggaacccaaacaacgtaaacccaaaccaaactaccccgaacgaaccggcccgtaaacccggacccttaacgaacgtcgggaaccctaggaacgggaccgtaccgtacggaagtactacgtacgaaccgacgaccggcgtagtaattacgtgtcgacgtagagacgtaggggtaaattacgtttacgaacgttcggtaacccttgttacgacttacggcgggtaccgacgggtaacccg

SEQ ID NO: 391930 - DNA, 624 bp, Homo sapiens
  misc_feature: GZ8MTXP02GXAZ1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtggaggtctcctgcaaggcttctggttacacctttaccaactatggtatcaggttgggtgcgacaggcccctggacaagggcttggagtggagtgggatggatcgagcgcttacgaagtggtacaacaactaaactatgacccacacgaaccctaccgagggacagacgtccaacatacgaccacagaaccacactaccacgacgccgacggcctaacagtacggacctaggaacggacgccgtagacgtactcgtacggaaccgaccgaccggtccgttacgtaacttacgtggtacgacggtaacgaggtaaggtacggggtaaaatttacgtttacgacgttcggttaccgttcgtttacgaaccgttacggtacgggtaccgtaacggggtaacccgttacggg

SEQ ID NO: 391931 - DNA, 634 bp, Homo sapiens
  misc_feature: GZ8MTXP02GXCE7.39.81.H04.1.454.CMB.2.raw
  modified_base (407)..(407): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacaaggcttgagtggatgggatggatcgagcgtcttacaagtggtacaacaaacaaactatcgaccaacacgaacctccgaagggccaagacgtcaaacccagtacgaaccaacgaanaaccaacactacccaaacgacgccaacggtaccctacgacgtacggaccctaggaacgggaacgcccgttaggacgtaattaccgtagggaaccgaaaccgacggggtacccgttgtaacttacgtggtcgacgaaggacgtaaggtacggggtaaaagtttagtttcgaacgttcggttaacccttgttacgactacggtcggggaccaacggggtaccctacggg

SEQ ID NO: 391932 - DNA, 651 bp, Homo sapiens
  misc_feature: GZ8MTXP02GWNUL.39.81.H04.1.454.CMB.2.raw
  modified_base (424)..(424): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctcctgacaaggtcttcgtaggttacctaccctttaaccaactagtggtatcgtaggttgggtgaccgacgacggcccctggaacgaaggtcttaggagtggagtgggagtggatcgaggcgtacttaacgaagtcggtaccaacgaaactaaactagtacgacccaacgaacgaaccctcgagggacaagcgtaccacanacgaccaacacgacactacacccgagacgaccaccgacctacacgtacggaccgtaggacggaccgtcgtagaacgtagtacgacggaaccgaaccgaccgggtacgtagttaacttacgtaggtagacggtaagaggtaggtaacgggtaaatttcgtttacgacgtttaccgtacgttcgtttacgaaccgttacgggtacggacctaacggggtacccttcggg

SEQ ID NO: 391933 - DNA, 656 bp, Homo sapiens
  misc_feature: GZ8MTXP02I8O8D.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttacaactatggtatcaggttgggtgcgacacggcccctggacaagggtcttggagtggagtgggatggatcgagcgtacttacaatggtacacaacaaactatcgccaacgaacgaaaccctccgaagggaccagacgtcaaccatacgaacccaacgaacgaccaacgactacccaacggaacgccaacccgggaccctaaccgacgttacgggaacccgtggaacgggacgacccgttaggaagtactcgtacggaaacgacgaccgggtcgtagtacttacgtgtacgacggagtacgaggtaacggggtaaatttacgtttacgaacgtttccggttaacccgttgtttacggtacgttaccggtacgggggtccctaaaccgggggtaacccgttcggg

SEQ ID NO: 391934 - DNA, 648 bp, Homo sapiens
  misc_feature: GZ8MTXP02GHRAZ.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatggggatggatcgagcgacttacaagtggtacaacgacaaactatcgacacagaacctcgagggcaggacgtcaaccatcgaaccacagaccacactcccaacgagccgacggccctacagtacggacctggaggacgcctaggacgatcgtagaaccgaccgacgggtaccgttagtaactttaccgtggtacgaccggtaaggaacggtaacggttaacgggggaaaattttacgttttacgggaaccgtttaccgggggtttaaccccctttcggttttaacggacccggtttaccgggtaccggggggtacccgtaaaccgggggtttaaacccccgg

SEQ ID NO: 391935 - DNA, 552 bp, Homo sapiens
  misc_feature: GZ8MTXP02HT2WD.39.81.H04.1.454.CMB.2.raw
  modified_base (374)..(374): a, c, t, g, unknown or other
  modified_base (468)..(468): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttaacatggtcacacaaactatgccacagaacctcgaggcagcgtcaacancgaaccacagaccacatacccacgacgccacggaccctacacgtcggacctggaggacgcctgagatcgtgaccgacgacggcgtgtattacgngtgcgagagaggtacgggaaattagtttcgacgtcggtacccttcgtttcgacgttacgtcggggaccgtacgggaaccctcgg

SEQ ID NO: 391936 - DNA, 721 bp, Homo sapiens
  misc_feature: GZ8MTXP02G6EI8.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggngcgacacggcccctggacaaggcttgagtggatgggatggatcgaggcgtacttaacgaagttcggtacaacgaaacctaaaactagtacgaccctaaaccgaacgaaaccccgtaccgaagggggaccaaacgggacggttacccaaaccgtaacgttaaccggaaacccccaaacgaaaccggtaaacccaaaccaacctaccccgaaaccgaacggacccgaaacccgggtccctaaaccgacgttaccgggaaccctagggaaacgggtacgacccgttaggaacgtacgtacgtaggaacccgaccgaccgggtacccggttagtaacgttacgtgtacgacgaaaggtagggagtaaacggggtaaaattaggttttcgaaccgttcggtacccttgtttacgaccgttacgggtcgggaccgtaacgggtaaccgtccgg

SEQ ID NO: 391937 - DNA, 577 bp, Homo sapiens
  misc_feature: GZ8MTXP02JLFVJ.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgatggaaacacctatgaattggttcagcagaggccaggccaatctaccaaggccacctaaatttataaaggtttcctaaccgggacttcgtggggtcccagacagacttcgagcggcaggtgggtcagggcactgaattcaacgactagaaatcagcgagggtggagcgtaggaggtagttggttaggggtttattacgtgactagtgacgtaaaggaacacgacgtacggtcctaccgttaactacgtttacggaccgtaaggggacctaaacggccgttagggacgactaacgaaaacgaacgttcggtaggactacgcgtaacccagtttccg

SEQ ID NO: 391938 - DNA, 630 bp, Homo sapiens
  misc_feature: GZ8MTXP02G1TN3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtgagtggatggatcagcgtcttaacaagtggtacaactaacaaaactatgacccacaacgaaccctccgaggggccaagacgtccaacatcgaacccacaacgaacaacactacccaacgacgaccaacccggtaccctaacacgtcgggaaccctaggaacgggacgcccgtaggaacgtacgtcgtaggaaccgaaaccgaccgggccgttaggttaacttacgtgtgacgagaggaaggttacggggaaaattagttttcgaacgttcggttaacccttgtttacgacgttacggcggggtacccgaacggggtaacccttcggg

SEQ ID NO: 391939 - DNA, 572 bp, Homo sapiens
  misc_feature: GZ8MTXP02HQDCF.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctgtatacattgatagaaactacctattgaattggttcagcagacggcaggccaatcctcaaaggcaccttaaatttagtaacggtttctaaaccgggattcgtacggggtcccagaccagtattcgagcggataggtgggtcagggcactgaatcacactagaaatcagcgagggtgagcgtaggaggtagttggttaggggtttattacgtgctagtgagaaacggacacgtacgtacggtccctacgttacttacgtttcgggaccgtacggggaccaaacgtcgtaggacgacgttaacgaaaacgtaacgtggtacggctacgactacctattccg

SEQ ID NO: 391940 - DNA, 646 bp, Homo sapiens
  misc_feature: GZ8MTXP02H8JA9.39.81.H04.1.454.CMB.2.raw
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggtactaccttacactatgtatcagttgggtncgacacggcccctggacgaagggtcttggaggtggagtggggattggatcgagcgtacttacgaagtggtacaacaaacaaaactatcgaccaacgacgaaccctccgagggaccaagcgtaccaaccatacgaacccaacgaagaaccaaccacacccaacgacgacccgaccgaccctacgacgtacggacctaggaggacgtccgtaggacgtacgtacgacggaccgacgaccggtacggttagtacgtttacgtggtacgacggagaacggtaggtacgggtaaattacgttttacgacgtttacggtacccctttaagtttacggtaaccgtacggtacggggtacccgtaacgggttacccgttcggg

SEQ ID NO: 391941 - DNA, 640 bp, Homo sapiens
  misc_feature: GZ8MTXP02FR765.39.81.H04.1.454.CMB.2.raw
  modified_base (273)..(273): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttctgttacacctttacaatatggtatcagttggngcgacaggcccctggacaagggcttggagtggagtgggatggatcgaagcgtacttaacaagtcggtaccaaactaaacaaaactatcgacccaacgaacgaaccctcgaagggcaagcgtaccaaccagtacgaacccaagacgtaaccaacgtacacccgaacggacgaccgaacccggacctaacgagtacggacctaggagacgtaccgtagagtactcgacggaaccgaccgaccgggtcgtagttaacgttacgaggtcggacgaaggtaaggtaacggttaacgggtaaatttcgtttacgaccgttacggttacccttgttacgacgttacggcgggtaaccgacggtaaccgttccgg

SEQ ID NO: 391942 - DNA, 610 bp, Homo sapiens
  misc_feature: GZ8MTXP02GJ6VE.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgtcttacaagtcggtacaacaacaaactatgaccacagaacctccgagggcagcgtcaccatacgaccacagacacactacccacgacgacacggacctacagtacggaccctaggacggacgccgtagaacgtactcgtacggaaccgaaccgaccgggtcccgttagtaacttacgtggtacgcggtaacggaggtaacggtacgggggtaaaatttagttttacgaacgttcggttacccttgtttacgacgttacggtcggggaccgtacggggtaacccttcggg

SEQ ID NO: 391943 - DNA, 663 bp, Homo sapiens
  misc_feature: GZ8MTXP02I5LN9.39.81.H04.1.454.CMB.2.raw
  modified_base (215)..(215): a, c, t, g, unknown or other
  modified_base (261)..(261): a, c, t, g, unknown or other
  modified_base (417)..(417): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttcgtggttactacctttaccaatntggtatcgaggttggtgacgacgacggcccctggacgaagggtcttggagtggagtgggagtggatcgagcgtacttaacaagttcgtacaaacaaacgtaaaactagtacgaccaacgacgaacccgtccgagggacagcgtcacatacgaccanacgacacactaccgaacgacgaccaaccggacctacgagtaccggaccgaggacggacgaccgtagaacgtacgttccgaacgggaacccgaaccggtaccgggtacgttacgttaaccgttaggtcgtacggaacggtaaggacggtaaggttaacggggttaaaatttcggtttacgacgtttaccgttaccgttgttacgtaaccgttacggtcgggaacccgtacgggaacccgtttccggg

SEQ ID NO: 391944 - DNA, 641 bp, Homo sapiens
  misc_feature: GZ8MTXP02GK3N2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacaggcccctggacaaggcttgagtggagtgggatggatcgagcgacttacgaagtggtacaacaactaaactatgacccacgacgaaccctcgagggcaggcgtccaacctagtacgaacccaacgacgaaccaaccgactacccgaacggacgacaaccgggaccctaacgaagtacgggaccctagggacggacgcccgttaggacgtacgtacgacggaaccgaccgacggggtcccgttaggttacttacgtgtgacgtaggagtacggtaacggggtaaattgtttacgacgttacggttacccttgtttacgaccggttacggtccggggtaccgaacggggtacccgttacggg

SEQ ID NO: 391945 - DNA, 632 bp, Homo sapiens
  misc_feature: GZ8MTXP02GBIE9.39.81.H04.1.454.CMB.2.raw
  modified_base (439)..(439): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggcccctggacaagggcttggagtggatgggatggatcagcgcttacaatggtacacaacaaactatgaccacacgaacctccgagggccaagcgtccaaccagtacgaaccacaagacacactacccagacacacgcctacatggacctagaggacncctaggagtactacgtacggaacgaccgacgggtaccgttagttaagttacccgtggtacgacggaaggtaaaggaggttaaaccgggggtaaaatttaggtttttacgaaacgtttccgggttaacccccttgttttacggaaccgttacgggttacgggggacccgtaacgggggtaacccctttccgggg

SEQ ID NO: 391946 - DNA, 601 bp, Homo sapiens
  misc_feature: GZ8MTXP02GQUZ7.39.81.H04.1.454.CMB.2.raw
  modified_base (510)..(510): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatggatcgagcgtcttaacgaattcggtacaacaacaaaactatgaccaacgaacgaacctccgaaggggcaagcgtaccaaccatacgaaccaacacgaaccacaactccaacgacgcaccgacctacgatcggacctagacggacgccgtagacgtacgtcgtacggaccgaaccgaccggtcgtagtacttacgngtagacgagagagtacgggtaaattcgtttacgacgttacggttaaccctgtttacgacttacggtacgggaccgtaacgggtacctacgg

SEQ ID NO: 391947 - DNA, 633 bp, Homo sapiens
  misc_feature: GZ8MTXP02JGFU5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttgagtggatgggatggatcagcgcttacaatggtcacacaaactatgaccacacgaacctcgagggcaggcgtcaccatcgaccacagacacactaccacgagcacgacctacagtcggacctaggacgggagcccgtaggaagtactaccgtacggaaccggaccgaaccgggtcccggtagtttaacgttacgtggtacggacggaacggtaggtaagggttaacgggggtaaaatttacggtttttacggaaccggtttacggttacccgttcgtttacgtaacggttaccggtcgggggacccggtaacggggtaaccccgtttcgggg

SEQ ID NO: 391948 - DNA, 680 bp, Homo sapiens
  misc_feature: GZ8MTXP02GF73W.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaacttatggtatcagttggtgcgacaggcccctggacaaggcttgagtggatgggatggatcgagcgtacttacgaatggtacaacgacaaaactatcgacacgaagaacctcgaagggcagagtacaaccatacgaaccaacgagaacaaccaatacccaacgacgaccgaaccggaccctaacgacgtacgggaacccgtagggaaacggggacggacccgtagggaagtaacgttaccgtacgggaaacccgaacccgaaccggggtccccgttaaggttaacttaaccgttgttacggaccggtaaggaaacggtaaggtaacgggggttaaaactttagtttttaacggacgttaccgggttaacccttcgtttacgaaccgttacggtacgggggtacccggtaacgggttaaaccccgg

SEQ ID NO: 391949 - DNA, 667 bp, Homo sapiens
  misc_feature: GZ8MTXP02HEBSX.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacgaagggcttgagtggatgggatggatcgagcgcttacaagtggtacaacaacaaactatcgaccacgtacgaacctccgagggacagacgtccaaccatacgaaccaacgacgtaaccaccactacccgaacgacgaccaacccgggtacctaacgagttacgggaccctaggaacgggacgtcccgtaggacgtacgttcgacgggaaacccgaccgtaccggggtcccgttaggttaactttaccgtgggttacggaccggaaaggtacggaggttaacgggggtaaaactttaggttttacgaacgttcggttaaaccccttgtttacgaaccgttacggtacgggggaccctaacggggtaaccccgtcggg

SEQ ID NO: 391950 - DNA, 622 bp, Homo sapiens
  misc_feature: GZ8MTXP02G156D.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggttcagcagagccagccaatctcaaggcactaatttataagttctaacggactcgtgggtcccagacagtatcgagcgagaggtggacaggcagtagtaactacaactaacgtaaagaaaacacgagacggaggggtaggaggtcgtaggaggtaagttaggggtttagggtttaaagttacgtaggactaagtacgaacgaaaacgggaaccaacgtaaccgtcggtaccccgttaccgtaccgttaaccggtttcgggacccggtaaacgggaaccgaaaggtcggtaaggaacgtaaactaaccgaaaaccggtacgtaggtcggtactacgaccaactacgtccgttacgtttcccg

SEQ ID NO: 391951 - DNA, 660 bp, Homo sapiens
  misc_feature: GZ8MTXP02JJJT1.39.81.H04.1.454.CMB.2.raw
  modified_base (386)..(386): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatctaggttgggtgcgacaggcccctggacaaggggcttggagtggagtgggatgggatcgagcgcttaacaagtggtacaacaacaaactatgacccacaagaacctccgaggggacaagngtccacatcgaacccacaagaccacactacccacgacgcctaaccgggccctaacagtacgggaaccctagggaacggacgcccgtaggaacgtatccgtacgggaacccgaacgaccgggtaccgttagtaacgttacgtggtacgacggaacgacggtaaggtacgggggtaaaatttcgttttacggaacgtttaccggttaaccccgttgtttacggtaaacccgttcgggtacggggtacccggtaaacgggggtacccctttacgggg

SEQ ID NO: 391952 - DNA, 664 bp, Homo sapiens
  misc_feature: GZ8MTXP02JUO17.39.81.H04.1.454.CMB.2.raw
  modified_base (350)..(350): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaagcttctggttacacctttacaactatggtatctaggttggtgcgacacggcccctggacagggcttggagtggagtgggatggatcgagcgtcttacgatggtacaacaacaaactntcgacacacgaacctcgaggcagacgtacacatcgaaccacgacgaccacactaccgaacgacgccacggaccctaacacgtcggacccgtaggacggacgccgtaggagtacgtccgtaggaaccgaccggtacgggtcccgttagttaactttacgtacggttacggaccggtaaggagggtaacgggttaaacgggggttaaaattttacgttttacggtaacccggtttaccggtttaaccccgtttacggttttacggaaccggttaccgggtaccgggggtacccgtaaccgggggtttaacccccgg

SEQ ID NO: 391953 - DNA, 602 bp, Homo sapiens
  misc_feature: GZ8MTXP02FUIZB.39.81.H04.1.454.CMB.2.raw
  modified_base (344)..(344): a, c, t, g, unknown or other
  modified_base (366)..(366): a, c, t, g, unknown or other
  modified_base (383)..(383): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactntgccacagaacctcagggcagngtcaaccatacgaccanagacacataccacgagcaacggccctaacagtcggacctagacggacgccctagagtatcgtagaaccgaccgacgggccgttagttaattaccgtgggtcgacggaaggaggtaaggtacgggggtaaaattaggttttacgaccgttacggttacccccttaagtttacggaaccgttacggttcgggggaaccctacgggggtaaccccttcgggg

SEQ ID NO: 391954 - DNA, 622 bp, Homo sapiens
  misc_feature: GZ8MTXP02FR6CT.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgataggaaacacctacttgaattggttacagcagagccagccaatcacagcactaatttataaggtttctaaccggactcgtcgggtcccagacagtatccgagcgcaggtggtcaggcatgaattcaacataagaaaatcgagacgagggtaggaggcgtaggaggtagttagggtttaggggtttaattacgtgtacgtagtacggacgaaacggaaccaacgtaaccgtcggtacccttaccgttaaccgttaccgttttacgggacccggtaacggggaacctaacggtaccgttagggaaagtaaacgttaacgaaaaaccgtaaccgtttaggaacggtacgtacggtacccaacctaacgttacgtttcgtttaccc

SEQ ID NO: 391955 - DNA, 581 bp, Homo sapiens
  misc_feature: GZ8MTXP02GETRD.39.81.H04.1.454.CMB.2.raw
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctcagggcagngtcaaccatcgaccacagacacatccaacgagcacgcctacactcggacctgacggacgccgtagaacgtatccgtagaaccgaaccgacgggaccgttagtaacttaccgtgtgacggaaggaagagtacgggggaaaattagttttcgaaacgttcggttaacccctgttttacgacttaacggtcggggaccctaacggggtaaccccttcgg

SEQ ID NO: 391956 - DNA, 542 bp, Homo sapiens
  misc_feature: GZ8MTXP02G3JRK.39.81.H04.1.454.CMB.2.raw
  modified_base (280)..(280): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctgtatacattgatgaaacacctactgaattggttcagcagagcagcaatcncagcactaattatagttcacggctcgtgggtccagacagatccagcgcaggtggtcagcatgaattcacacagaaaactcagcgagggtggaggcgtagagggtagttagggtttaggggttacttacgtagtctagtagacgaaaggaacaacgacgtcggccttacgtacgtcgtttacggacgaacggggaccaggcgtaggacgtacgtaaccgaaaacgtacgttacggcgtactacgaccactacttcgtactttc

SEQ ID NO: 391957 - DNA, 560 bp, Homo sapiens
  misc_feature: GZ8MTXP02JEKR6.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaattggttcagcagagccaggccaatcacaagcactaattataaggtttcaaccggactcgtgggtcccagacagatcagcgcagtggtcaggcatgtaacttcacaactagaaaatcgagacgaggggtggaggcgtagaggtagttagggtttaggggtttaattacgtgactagtacgacgaaaggaccaacgacgtcggtacctaccgtaactacgtttcggaccgacggggtaaccgtaaggtaggaaaactacgaaacgaactggtagactcgacacctatcgtacgttctactaccg

SEQ ID NO: 391958 - DNA, 561 bp, Homo sapiens
  misc_feature: GZ8MTXP02HDM2S.39.81.H04.1.454.CMB.2.raw
  modified_base (344)..(344): a, c, t, g, unknown or other
  modified_base (379)..(379): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactntgcacagacctcgaggcagcgtcaccatcgaccanagacacatccacgagcacgctacatcggacctgaggagcctagacgtatcgtagaccgacacgggccgtaggtacttacgtgtagcgtagagagtacggggtaaaattagtttacgaacgttcggttaacccttgttttacgaccgttacggtcgggggacccgtaacggggtaaccctcgg

SEQ ID NO: 391959 - DNA, 577 bp, Homo sapiens
  misc_feature: GZ8MTXP02H6SDA.39.81.H04.1.454.CMB.2.raw
  modified_base (293)..(293): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggttcagcagaggccagccaatctaccaaggcncctaaatttataagtttactaaccgggatcgtgggcccagacagtatcagcgcagtggcaggcactgaaacttcaacactagaaaactcagcgagggtggaggctaggaggagttggttaggggtttattacgtgtactagtggacaaagggaacacgaacgtcggacccttaccgtaactaaccgtttgggacccggtaacggggaaccaaggccgttaggaaggaactaaccgaaaacgtaacgtggtaacggacctagtaccacctactccgttacgttcc

SEQ ID NO: 391960 - DNA, 671 bp, Homo sapiens
  misc_feature: GZ8MTXP02J0UYA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgacttacaagtggtacacaacaaactatagaccacagaaccctccgaggggccagacgtcaacccatacgaacccaacacgaccaacaactacccaacgacgaccgaaccggccctaacacgtacggaacccgtggaacgggacgacccgtaggaagacgttacgtacggaaccggaaccgacccggggtacccggttagttaacgttaccgttggtacggacggaacgggtacggaaggtaccgggggtaaaatttaggttttacggaccgtttacgggttaacccctttgtttacggtaaccgttacgggttacgggggacccgtaacgggggtaaccccgttccgggg

SEQ ID NO: 391961 - DNA, 671 bp, Homo sapiens
  misc_feature: GZ8MTXP02H3O3F.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgctttacaagttggtacaaacacaaaactatcgacaacacgaaaccctcgaggggcaggagtcaaccatacgaacccacaacgacaacactacccaacgacgccaaccgggaccctaacgaacgttacgggaccctaggaacgggaacgtcccgtaggaacggaacttcgtacggaaccgaacgaaccgggtcccgttaggttaacgttaaccgtggttacggcggaaaggacggtaaacggttacgggggtaaaacttttacgttttacggaaccgtttacgggtttaacccctttagtttacggtaccgttacggttaccgggggacccgtaaacgggggtaaccccg

SEQ ID NO: 391962 - DNA, 660 bp, Homo sapiens
  misc_feature: GZ8MTXP02GNKBN.39.81.H04.1.454.CMB.2.raw
  modified_base (469)..(469): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacatatgtatcagttggtgcgacacggcccctggacaagggtcttggagtggagtgggatggatcgagtcgtacttacaagttggtacacaactaaactatacgacccaacacgaacccgtaccgaggggaccaaggacgtaccaccatacgaacccacacgaaccaacactacccacgacgaccgaccggacctacacgtacggacctggaacggacnccgtaggacgtacgtcgtacggaccgaaccgtaccggcgttagttaacgttacgtggtacggaccggtaagtaggaacggttaacgggggtaaaatttagttttaccggaaccgtttacggttaccccgtttaagtttaccggtaacgttacgggtaccggggaccgtaaccgggggtaacccgttccggg

SEQ ID NO: 391963 - DNA, 672 bp, Homo sapiens
  misc_feature: GZ8MTXP02I2R6U.39.81.H04.1.454.CMB.2.raw
  modified_base (258)..(258): a, c, t, g, unknown or other
  modified_base (273)..(273): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgcaggtcttctgttactaccttacatntgtatcgaggttggngcgacgacggccccgtggacgaggtcttggagtggagtgggatggatcgagcgtacttaacgaagtcggtacaaccaaactaaactagtcacccaacgtaccgaacctccggagggacaagtcgtaccaacacgtacaaccacaacgacaactcacccacgacgacgaacccggtacctaacgacgtacggaaccgaggaacggtaccgctaaggactctaccggaccggaacgaaccgtccggtacgttagtacgttacgtcggtacggacgaagggtagtaacgggtaaacgggttaaatttacggtttacgtaccggtttacggttacccgtttaacgtttacggaaccggtttacggggtaccgggacccggtaaaccgggtaccgtttacccgg

SEQ ID NO: 391964 - DNA, 613 bp, Homo sapiens
  misc_feature: GZ8MTXP02HVOUS.39.81.H04.1.454.CMB.2.raw
  modified_base (349)..(349): a, c, t, g, unknown or other
  modified_base (372)..(372): a, c, t, g, unknown or other
  modified_base (402)..(402): a, c, t, g, unknown or other
  modified_base (439)..(439): a, c, t, g, unknown or other
  modified_base (474)..(474): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttacaactatggtatcagttgggtgcgacacggcccctggacaaggcttgagtggatgggatggatcgagcgtacttacagtcggtcaacaacgtaaaactntgaccacacgacctcgaggcagngtcacagtcgaccacagacacatccagacncgacgctacgagtcggacctggagacgcctgaacgtntcgtaggaccgacgtacggccgttagtacttacgnggttacgacggaaggtaacgtacgggttaaacggggtaaaattttacgttttacggaccgttttacggttaacccccgtttgtttcggaaaccgtttacgggacgggggtccctaaaaccgggggttacccttccgggg

SEQ ID NO: 391965 - DNA, 620 bp, Homo sapiens
  misc_feature: GZ8MTXP02JVDFZ.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatcctcctgcaggtctagtcaaagcctcgtatacattgatacggaaacacctacttgtaattggttcagcagaggccaggccaatcctacaaggcgtaccttaaatttataacggtttctaaaccgggacttcggtggggtccccaggacagtattacgaggcggtacaggttggggtccagggctacgtgaacttcaacactagaaaatcagcgagggtggaggcgtggaaggtagttagggtttagggtttaagttcgttagacgtaagtgacgaaaggaacaacgaaccgtcgtacccgtaccgtacgttaaccgtttcggaccggtaacggggaaccgaaacggacgtacggaacgacgtaaccgaaaacgtaacgtcggtacggccgtagacctaaccgtacgttccg

SEQ ID NO: 391966 - DNA, 630 bp, Homo sapiens
  misc_feature: GZ8MTXP02JNHYI.39.81.H04.1.454.CMB.2.raw
  modified_base (322)..(322): a, c, t, g, unknown or other
  modified_base (386)..(386): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaaggggcttgagtggatgggatggatcagcncttacaatggtcacaacaaactatgaccaacagaaccctcaggggcagcgtcaccatgaaccanaacgacacatccaacgacgaccgtaacgaccctaacgacgtacggaccctaggaaggaacgcccgttaggaacgtatcgtacgaccgaaaccgacgggacccgtagttaacgttaccgttaggtcgaccggaaggaacgtaacggtaacgggggtaaaattagtttttacgaaccgttagggttaaccccttgtttacgaacgttacggtacggggacccgtaacgggggtaacccttacgggg

SEQ ID NO: 391967 - DNA, 637 bp, Homo sapiens
  misc_feature: GZ8MTXP02GVFJE.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggggtgcgacaggcccctggacaagggcttgagtggatggggatgggatcgagcgcttacgaatggtcaacaacaaactatgccacagaacctccaggggcagagtcaaccatcgaaccacacgacacatccacgagaccgacggaccctacagtcggaccctggaacggacgcccgttaggaacgattccgacgggaaccgaaccgtaaccgggtcccggttagttaacgtttaaccgttgggttagaccgggaaaggtaggaacggttacgggggaaaatttagttttacggaccgtttacgggttaaccccttgtttacgaccgttaacggtcgggggacctaacggggtaacccccttagggg

SEQ ID NO: 391968 - DNA, 556 bp, Homo sapiens
  misc_feature: GZ8MTXP02F0XGB.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagagccaggccaatctcaaggcgacctaatttataaggtttctaaccgggactcgtcggggtacccagacagactcagcgcagtggtcaggcactgaattcaacactagaaaatcagcgaagggtggaggcgtagaggagttgggttagggggtttattaacgtgtcgtagtgacgaaagggaacacacgtcggccgttaccgtactacgttttcgggaccgacggggaacgaacgcgtaggaacgataacgaaaacgaacgtggtacggctcgaccaccatcgttcg

SEQ ID NO: 391969 - DNA, 676 bp, Homo sapiens
  misc_feature: GZ8MTXP02H9Q4W.39.81.H04.1.454.CMB.2.raw
tcagtcgcactagtcacgaccggtgctcgatttagtagtgtagattcgcggggacccaaaaaccacacccctcccttgggagaatccccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactaccttacaactatggtatcaggttgggtgcgacgacggcccctaggaccaagggctggagtggagtgggatggatcgaagcgacttaacgaagtggtacaacaaaccaaaactagtacgacccaacaacggaaaccctccgaggggaccaaggcgtaccaaacactacgaacccacgaacaaccaacacacccgaacgacgaccgaaccggtaccctaacgacgtacgggaaccctaggaaacggacgtccctaggaaaggtactacgacgggaccgaaccgaaccggggtccgttaagttacgtttacgtaggtacggacgtaaggaggtaacggtacgggtaaaatttagtttacgaccgttcgggttaaccccttgtttacgaacgttcgggtaccggggacccgtaacggggtaacccctcggg

SEQ ID NO: 391970 - DNA, 662 bp, Homo sapiens
  misc_feature: GZ8MTXP02JBQHN.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgaggttgggtgcgacgacggcccctggacaagggcttggagtggatgggatggatcgagcgtacttacaagtggtacaacaacgtaaaactatcgacccaacgaacgaaccctccgagggacaagacgtaccaccaagtacgaacccaacgaacgaaccacactacccgaacgacgaccgaacccggacctacgaacgtacggaaccgtaggaacggacgaccgtaggaacgtagttaccgaggaacccgaaccggaaccgggtccgttagtaacgtttacgtaggtacgacggaaggagtaacggtaacggggtaaaatttcggtttacgaaccgtttcggtacccttaagttacgaaccgttacgggtcgggacccgtaacgggtacccttacgg

SEQ ID NO: 391971 - DNA, 515 bp, Homo sapiens
  misc_feature: GZ8MTXP02HO9G2.39.81.H04.1.454.CMB.2.raw
  modified_base (276)..(276): a, c, t, g, unknown or other
  modified_base (404)..(404): a, c, t, g, unknown or other
  modified_base (421)..(421): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctccagtctcctgcccgtcaccttggacagccggcctcatctcctgcaggtctagtcaaagcctcgtatacattgataggaaacactactgaattgttcagcagagcagcaatcncaagcactaattataagttcaacggactcgtgggtccagacagatcagcgcagtggtcaggcactgaattcaacactagaaaatcagcgagggtggaggcgtagaggatggttagggtttatacgtgnagtagagaaaggaacanacgtgaccctacaatactacgtttcggaccgaaggggaaccagacgtggaacgaactaacgaaaacgataagtcggactcgacacacttactcg

SEQ ID NO: 391972 - DNA, 668 bp, Homo sapiens
  misc_feature: GZ8MTXP02F98J5.39.81.H04.1.454.CMB.2.raw
  modified_base (403)..(403): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggagtgggatggatcagcgtcttaacaagtggtcaacgaacaaaactatgacccaacgacgtaaccttcgaggggccagacgtcaaccatacgaccaanacgaaccacactacccaacgacgaccaaccggaccctacagtcggaccctaggacggacggcccgaaggactccgacggaaccggaccgaccgggccgttagttaacgtttaccgtgtacggacgaaggaacggtacggtaaacgggggtaaaactttaggttttacggtaaccgtttacgggttaaccccctttgtttaacggtaacccgttacgggttaccgggggaacccgtaaacgggggtaaccccgttcggttaccccg

SEQ ID NO: 391973 - DNA, 662 bp, Homo sapiens
  misc_feature: GZ8MTXP02HEEWA.39.81.H04.1.454.CMB.2.raw
  modified_base (348)..(348): a, c, t, g, unknown or other
tcagtcgcactagtcacgaccggtgctcgatttagtagtgtagattcgcggggacccaaaaaccacacccctccttgagagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcgagcgcttacaatggtacaacaacaaactntacgacaacacgaaccctccgaggggacaggacgtaccaaccatcgaaccaacgaacgaaccaacaactacccaacggacgacccgaaccggtaccctaacgacgtacgggaccctagggaaacgggacgtacccgtaggaacggacttaccggtacggaacccgaaccgacccggggtaccgttaggttaacgttacgtggtacggacggaaggaaggtaacggtaacgggggtaaaatttagttttacgaacgtttcggtaacccttcgtttacgacgttacggtacggggacccgtaacggggtaaccccg

SEQ ID NO: 391974 - DNA, 563 bp, Homo sapiens
  misc_feature: GZ8MTXP02I29AF.39.81.H04.1.454.CMB.2.raw
  modified_base (264)..(264): a, c, t, g, unknown or other
  modified_base (317)..(317): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactactgaattggttnagcagaggccaggccaatctcaaggcgcctaatttataaggttctaaccgggntcgtggggtcccagacagactcagcgcagtggtcagggcactgaattcacactagaaaatcagcgaggggtcggaggagtggaggtagttagggtttggggtttattacgtagtctagttagagaacgggaaacacgaacgtcggaccctacgtacgtacgtttcggaccgacgggaccgaagtccgtaggaacgacgtaacgaaacgtacgtcggtggtaccgtacgaccgtacacgtcgtttcg

SEQ ID NO: 391975 - DNA, 545 bp, Homo sapiens
  misc_feature: GZ8MTXP02H2FTJ.39.81.H04.1.454.CMB.2.raw
  modified_base (264)..(264): a, c, t, g, unknown or other
  modified_base (280)..(280): a, c, t, g, unknown or other
  modified_base (282)..(282): a, c, t, g, unknown or other
  modified_base (288)..(288): a, c, t, g, unknown or other
  modified_base (316)..(316): a, c, t, g, unknown or other
  modified_base (334)..(334): a, c, t, g, unknown or other
  modified_base (339)..(339): a, c, t, g, unknown or other
  modified_base (346)..(346): a, c, t, g, unknown or other
  modified_base (352)..(352): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaaacactatgaattggttnagcagagcaggccaancncaagcnctaattataaggttctaacgggactcgngggtacccagacagactnagcgnagtggcnggctangtaattcaacactaagaaatcgagacgaagggtggagctaggaggtagtggtttggggttattacgtgtacagtgacaaggaacacgacgtcgtaccgtaccgtacttacgtttacggacgtacggggacctaggcgtagggaacgacgtacgaaacgtacgtaagtcggactcgacctacgtacttcgtacg

SEQ ID NO: 391976 - DNA, 672 bp, Homo sapiens
  misc_feature: GZ8MTXP02J3WYN.39.81.H04.1.454.CMB.2.raw
  modified_base (399)..(399): a, c, t, g, unknown or other
tcagtcgcactagtcacgaccggtgctcgatttagtagtgtagattcgcggggacccaaaaaccacaccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacctacctttacaactatggtatcagtggtgcgacacggcccctggacgaggcttgagtggagtgggatggatcgagcgtacttacaagttcggtacaaccaacaaacctatcgacccacgaacgaccccgtacgaggggacctagcgtacaaccncgtacgaccacaacgaacaaccactaccgaccgacgaccgacccgtaccgtaactacgtacgggtaccgtacgggacgggacgtaccgtcgagtacgtacgtaccggaccgaacccggaccggtaccggtgttaacgtttacgttacgggtgacggaaggaggtaacgggttaaacggggttaaacttagtttttacgtacgttaccgttacccgtttccgtttacgtaccgttaccggtacggggcccggtaaccggtaacccggttcccgg

SEQ ID NO: 391977 - DNA, 533 bp, Homo sapiens
  misc_feature: GZ8MTXP02FK5AR.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgccacagaacctccgagggcagngtcacatcgaccacagacacatccagagcacgccacagtcggactagaggacgcctagagatctagacgacgacggccgtagtactactgtgacgagagagtacggggaaattagtttacgacgtcgtaccctcgttacgactacgcggggaccacgggacctcgg

SEQ ID NO: 391978 - DNA, 598 bp, Homo sapiens
  misc_feature: GZ8MTXP02HKW7H.39.81.H04.1.454.CMB.2.raw
  modified_base (274)..(274): a, c, t, g, unknown or other
  modified_base (436)..(436): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatgtatcagttggtncgacaggcccctggacaaggcttgagtggatgggatggatcagcgcttacaatggtcacacaaactatcgacacacgaaacctccgaaggggccaggacgtaccaaccctatacgaacccacgacgaaccacactacccaacggacacgaccggtaccctanacgtggaccctgaagggacgcctggaacgctacgtagaaccgacgacggtccgtagttacttacgtggtcgacgtaggagagtacggggaaatttagtttacgacgttacggtaacccttgtttacggtacgttacggtcggggtaccgtaacgggtacccg

SEQ ID NO: 391979 - DNA, 670 bp, Homo sapiens
  misc_feature: GZ8MTXP02H5DHI.39.81.H04.1.454.CMB.2.raw
  modified_base (388)..(388): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttaccaactatggtatcagttgggtgcgacacggcccctgggacaagggcttgaggtggagtgggatggatcgagcgacttacaagtggtacaacaacaaactatcgaccaacacgaaaccctccgaagggcaacgngtccaacgacgtacgaacccaacaacgaccactacacccaacgacgaccaaccggaccctacagttacggacccgtggaacgggtacgaccgtaggacgtacgtccgtacggaaccgaccgaccggggtaccgttacggtacgtttaccgtggtcggacggtaggaacgggtaggttaacgggggtaaaacgtttagtttacggtaccgtttcggttaacccctttgtttacgtaaccgttacgggtacggggtacccggaacggggttaacccttccgggg

SEQ ID NO: 391980 - DNA, 665 bp, Homo sapiens
  misc_feature: GZ8MTXP02H7077.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcgagttgggtgcgacgacggcccctggacaagggcttggagtggagtgggatggatcgagcgtacttaacaatcggtacaacaaacaaactatcgaccaacaacgtaaccctcgaagggcagcgtaccaacagtacgaaccaacgaacgaccaactacacccgaacgacgacccgaacccggtacctaccgaagtccggaaccctagggaacggaacgtcccgttaggaactacgttcgacgggaacccgaaccgaccgggtccgttagttaaacgtttacgtcggtacggacggaaggaaggtaacgggttaaacggggtaaaatttgtttacgacgtttaccggtaacccttgtttacgaacttacgggtcggggaacctacgggtaacccgttcgg

SEQ ID NO: 391981 - DNA, 605 bp, Homo sapiens
  misc_feature: GZ8MTXP02JLAY4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacgaagggcttgagtggagtgggatggatcagcgcttacaagtggtacacaacaaactatgaccacacgaacctcgagggacagcgtacaccatcgaccacagacacactacccacgacgaccaccggacctacgacgtacggaaccctaggacggacgccgtagaacgagtctaggaaccgaccgacgggtacccgtagtacttacgtggtgacgagaggtacggtacggggtaaaattcgtttacgaaccgttcggtaccccttgttacgtaaccgttacggtacggggtacccgtaacggggacccgttacggg

SEQ ID NO: 391982 - DNA, 685 bp, Homo sapiens
  misc_feature: GZ8MTXP02I4DCY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttaccaccctttaccaacttatggtatcgtaggttggggtgcgacgacggcccctggacgaagggcttggagtggagtgggatggatcgagcgtacttaacaagtcggtacaacgaaacaaactatcgaccctaacaacgaaccctccgaaggggcaagtcgtaccaactagtacgaacccaacgaacgaaccactaactacccgaacgaacgacccgtaaccggaccctaacgagtacgggaaccaggaacggacgaccgtagacggtactcgtacggaaccgaccgacgggtaccggttagttaacgttccgtgggtacgacggtaaggacggtaagggtaccggggtaaaaatttcgtttacggaacgtttcggttaaccccttgtttacggaaccgttacgggtacggggtacccgtaacggggtaacccttacggg

SEQ ID NO: 391983 - DNA, 632 bp, Homo sapiens
  misc_feature: GZ8MTXP02GKOF7.39.81.H04.1.454.CMB.2.raw
  modified_base (356)..(356): a, c, t, g, unknown or other
  modified_base (405)..(405): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatggatcgagcgtacttaacaagttggtacaacaaacaaaactntgacccaacacgaacctccgaggggccaggcgtccaaccatcgaaccanagaccacactacccaacgacgaccaaccggaccctaacagtacggacctaggaggacgcctaggagtactcgtacgaaccgaccgacggtccgttaggtaacttacgtggtcgacggaagaacggtaagtacgggggtaaaatttgttttacgacgttacggttaaccccttgtttacggaacgttaccgggtacggggacccgtaacggggtaacccctttacggg

SEQ ID NO: 391984 - DNA, 585 bp, Homo sapiens
  misc_feature: GZ8MTXP02GML2E.39.81.H04.1.454.CMB.2.raw
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaaggcttgagtggatgggatggatcgagcgcttacaatggtacacacaaactatgccacagaacctccagggcagngtcaccatgaccacagacacatccacgacgcacggacctacatacgggacctggacggacgccgtaggacgatccgtaggaaccgaccgaccgggtaccgttaggtaacttaaccgtggtacgacggaagacggagtacgggggtaaaatttgtttacgacgttacggttaccctgtttacgacgttacgtcggggacctacggggtaacccttcggg

SEQ ID NO: 391985 - DNA, 524 bp, Homo sapiens
  misc_feature: GZ8MTXP02HM2I8.39.81.H04.1.454.CMB.2.raw
  modified_base (252)..(252): a, c, t, g, unknown or other
  modified_base (283)..(283): a, c, t, g, unknown or other
  modified_base (288)..(288): a, c, t, g, unknown or other
  modified_base (294)..(294): a, c, t, g, unknown or other
  modified_base (304)..(304): a, c, t, g, unknown or other
  modified_base (306)..(306): a, c, t, g, unknown or other
  modified_base (324)..(324): a, c, t, g, unknown or other
  modified_base (346)..(346): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctactgaattggttcagcagagcagcatcncagcnctatanagttcacggntnggccagacagatcagcgnagtggtcaggcatgaattcaanactagaaatcagcgaggtgaggctgagagtgttagggttattacgtgctagtagacgaaaggaacacgacgtcgcctccgtaactacgtttggaccgtaacggggaccaaaggcgtagggaacgtacgtaaacgaaacggtaacgtaggtacgggctacggcctaacccgatttcccg

SEQ ID NO: 391986 - DNA, 617 bp, Homo sapiens
  misc_feature: GZ8MTXP02JE2TT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcagcgacttacaaagttggtacaacgaacaaaactatacgaccaacgaacgaaaccctccgaaggggccaaggacgtccaaccatacgaacccaacgaacgacaacaactacccaacgacgaccaaccggaccctaacgaagtcggaaccctgaagggacgaccgtagaacgataccgtagaaccgaaccgaccgggtcgtacgtattacgtgtacgacgagagacgtacgggtaaattagtttacgacgttcggtaccttcgtttagactacggtcgggaccgacggggaacccttcgg

SEQ ID NO: 391987 - DNA, 594 bp, Homo sapiens
  misc_feature: GZ8MTXP02JFLIJ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatggatcgagcgcttaacaagtggtacacaacaaactatgaccacacgaacctccgagggcagcgtcaacatacgaccacacgacaacactcccaacgacgacaaccggacctacgacgtacggaaccctaggaacggacgccgtagacgtatcgtaggaccgacgaccggcgtagttaattaccgtgtgacggtagaggacgtacggggaaaatttcgtttacggacttcggtaacccttgtttacgacgtacggtcggggacccgtacgggtacccgttcgg

SEQ ID NO: 391988 - DNA, 575 bp, Homo sapiens
  misc_feature: GZ8MTXP02IVGWX.39.81.H04.1.454.CMB.2.raw
  modified_base (430)..(430): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacgaacaaactatcgccaacgacgaaccctccgagggccaagcgtcacatcgaccacacgacacactccaacgacgcacgacctacatcggaccngacggagccgtagacgatcgtagaaccgacgaccgggtccgtgtaacttacgtcgtgcgaacgagagtacgggggtaaattagtttacgacgttcggtacccttgttacgtacgtacgtacggggtaccgacgggtaccctacgg

SEQ ID NO: 391989 - DNA, 636 bp, Homo sapiens
  misc_feature: GZ8MTXP02GHE18.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggtcttcgtaggttaccacctttaccaactatggtatcaggttgggtgcgacaggcccctggacaagggcttgagtggatgggatggatcagcgtcttaacaagtggtacaacaaacaaaactatcgaccacagaaccctccgagggcagcgtacaccatacgaccacacgacacactaccaacgacgaccgaaccggacctaacgacgtacggacctacggaggtacgcctaggactacgttcgaggaccgaacgaccgggtccggtagttaacgttaccgttgacggacgtacggaggtacggttacgggggtaaaaatttcggtttacgaccgttccggttaaccttcgtttaacgaccgttaacgggtcgggaccggtaacggggtaacccgttcggg

SEQ ID NO: 391990 - DNA, 535 bp, Homo sapiens
  misc_feature: GZ8MTXP02JG99Y.39.81.H04.1.454.CMB.2.raw
  modified_base (274)..(274): a, c, t, g, unknown or other
  modified_base (345)..(345): a, c, t, g, unknown or other
  modified_base (381)..(381): a, c, t, g, unknown or other
  modified_base (389)..(389): a, c, t, g, unknown or other
  modified_base (404)..(404): a, c, t, g, unknown or other
  modified_base (415)..(415): a, c, t, g, unknown or other
  modified_base (420)..(420): a, c, t, g, unknown or other
  modified_base (425)..(425): a, c, t, g, unknown or other
tcagtcgcactagtcacgaccggtgctcgatttagtagtgtagattcgcggggacccaaaaaccacacccctccttgggagaatcccctagatcacagctcctaaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtncgacaggcccctggacaagggcttgagtggatgggatggatcgagcgcttacaagtggtacacacaaactntgcaaccagaacctcaggcagagtcacatcgaccanagacacanccacgagcacgctantgactgagacnctganatcgngacgacacggctagtatacgtgtgacgagagagtacggggtaaattgtttacgacgttacggtaccttgttgacgttacggtcggggaccacgggtaaccctggtacccg

SEQ ID NO: 391991 - DNA, 596 bp, Homo sapiens
  misc_feature: GZ8MTXP02I1RHV.39.81.H04.1.454.CMB.2.raw
  modified_base (253)..(253): a, c, t, g, unknown or other
  modified_base (347)..(347): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctctgcaggtctagtcaaagcccttcgtatacattgataggaaacncctattgaatttggttcagcagagccagccaatctccaaggcacctaatttataacggtttcaacggctcgtggggtcccagacagatcagcgnaggtggcaggcatgaacttcaactactagaaaatcgagacgagggtgagcgtggaggtagttgttgggtttaattacgtcggactagtagaccgtaaaggaaccacgtacgtacggtacccgttaccgtaacgttacgttttacgggacccgtaaagggggtaaccctaaaggtaccggttacgggaacgtaaacgtaaccgaaaacggtaaccgtggttacggacctacggaccaccgttagtttccg

SEQ ID NO: 391992 - DNA, 564 bp, Homo sapiens
  misc_feature: GZ8MTXP02F6TN9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacaacacaaactatgaccacacgaacctccgaagggccaaggcgtcaccatcgaccacagacacatccacgacgcacgcctacatcggacctagacggacgcctagacgatcgtagacgacgacggtccgtgtaattacgtagtgacgagagagtacggggtaaattacgttttcgacttcggtacccttgttacgacgttacggtcggggtaccacggggtaccctacgg

SEQ ID NO: 391993 - DNA, 636 bp, Homo sapiens
  misc_feature: GZ8MTXP02GJ8GP.39.81.H04.1.454.CMB.2.raw
  modified_base (273)..(273): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacactatggtatcagttggtncgacaggcccctggacaagggcttgagtggatgggatggatcagcgtacttacaatggtcaacaacaaactatgaccacacgaacctcgagggcagacgtcacagtcgaaccacagacacactaccacgacgacaccggacctacgagtcggacctaggacggacgccgtaggacgtactcgacggaccgaccgacgggtccgttagttaacgttacgtggtacgacggtaaggacggtaaacggttaacgggggttaaaatttacggttttacgtaccgtttaccgggtttaccctttaacggtttacggtaaccgttacgggtaccgggggtacccgtaacgggggtaaccccgtttcggg

SEQ ID NO: 391994 - DNA, 614 bp, Homo sapiens
  misc_feature: GZ8MTXP02JIX74.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacactatggtatcagttgggtgcgacgacggcccctgggacaagggtcttaggagtggatgggatggatcgagcgtacttaacgaatggtaccaacgaactaaactatgacccaacaacgaaccctaccgagggacaagcgtccaaacatacgaccacacgtaacaccactacccaacgacgaccgaaccggactacgagtacggaccgaggacggaacgtccgtaggagtaacgtcgacggaacgaccgacggtctagttactacgtgacgcgtaacggagtaggtaacgggtaaattacgtttcgacgttcggtacccttgttacgaaccgtacggtaccggcgtaaaccggtcttaccgg

SEQ ID NO: 391995 - DNA, 537 bp, Homo sapiens
  misc_feature: GZ8MTXP02IY8Z4.39.81.H04.1.454.CMB.2.raw
  modified_base (344)..(344): a, c, t, g, unknown or other
  modified_base (368)..(368): a, c, t, g, unknown or other
  modified_base (382)..(382): a, c, t, g, unknown or other
  modified_base (415)..(415): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccctttaccaactatggtatcagttggggtgcgacaggcccctggacaagggcttgagtggatgggatggatcagcgcttacatggtcacacaaactntgaccacagaacctcgagggcagngtcaccatgaccanagacacatccacgagcacgcctacagtcgaccngaggacgacctgacgatctagaccgacgcggcgtgtatacgtgtgcgagagagtacggggtaaattagtttgacgttcggttacctgtttcgactacggtcgggaccgacgggtaccctcgg

SEQ ID NO: 391996 - DNA, 689 bp, Homo sapiens
  misc_feature: GZ8MTXP02FK2DW.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtncgacaggcccctggacaagggcttgagtggagtgggatggatcgagcgtcttaacgaatggtaccaacaaacaaaactatgacccaacaacgaaacctccgaggggacaaggagtccaaccaatacgaacccaacacgaaacctaacactacccgaacgaacgccaaacccgggtaccctaactaacgtcgggaaccctagggaacggggaacgccccgttaagggaacgtaacgttccgtaacgggaaaccggaacccgaccggggtacccgtttaggttaaactttaaccgtggtagaccggaaggtaggaaacggttaacgggggtaaaaatttgtttacgaccgttcggttaccccttaagtttacgaacgttacggtcgggggaccctaacgggggtaaccccttcggg

SEQ ID NO: 391997 - DNA, 621 bp, Homo sapiens
  misc_feature: GZ8MTXP02IIFR7.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccaggtggggatgttgtgatgactcagtctccagtcctccctgcccgtcacccttggacagccggcctccatctcctgcaggtctagtacaaagcctcgtatacattgaatacggaaacacctattagaattggttacagcaggaggccaggaccaatctaccaaaggcctaccttaaatttagtaacggtttcaaccgggacttcgtaggggtacccagacagtacttcgaggcgcgtaggtgggtcaggcctagtagaacttacaacactaagaaaatcaagacgagggtggaggctaggaggtagttgggtttaggggtttattacgtgactagtagacgaaaggaactacgacgtcggacccttacgtacttacgtttcggaccggtaacgggaacaggtaccgtaggacgaaacgttaccgaaaaacgtacgtagggtaacggtacgtacgtacccgaacctacttacgttacgtttaccc

SEQ ID NO: 391998 - DNA, 710 bp, Homo sapiens
  misc_feature: GZ8MTXP02IMCA2.39.81.H04.1.454.CMB.2.raw
  modified_base (364)..(364): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtaggttactaccctttacaactatggtatcaggttgggtgcgacacggcccctaggacaagggcttgagtggagtgggatggatcgagcgtacttacaagttggtacaacgaaacaaactagngaccaacacgaaacctcgaagggacaagcgtaccaaccaagtaccgaacccaagaacgaacaacactacccgaacgacgaccgaacccggtacctaaacgagtaccgggaacctagggaacgggacgaccctaaggaacggtacttcgacggaaaccgtaaccggaaccgggtcccggtttattaacgttaccgttagtacgggagtaaaacgggaacgggtaaggttaaacgggggttaaaatttacgttttaacggaaccgtttaccggttaaccccttggttttaaccgaaccggtttaacggttccgggggaacccgtaaaccgggggtaacccttccgggg

SEQ ID NO: 391999 - DNA, 613 bp, Homo sapiens
  misc_feature: GZ8MTXP02I9545.39.81.H04.1.454.CMB.2.raw
  modified_base (244)..(244): a, c, t, g, unknown or other
  modified_base (277)..(277): a, c, t, g, unknown or other
  modified_base (333)..(333): a, c, t, g, unknown or other
  modified_base (358)..(358): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctccagtctccctgcccgtcaccctggacagccggcctccatctctgcaggtctagtcaaagcctgtatacattgatgaaacnctattgaattggttcagcagagccagccaatcncagcactaattataaggtttcaacggctcgtgggtaccagacagtatccgagcggntaggtgggcaggcactgaacttcanactaagaaaatcgagtacggagggtaggaggtcgtaggaggtagtttgggtttaggggtttattacgtgactagtagaacgaaaggaacacgtaccgtcggtacccttacccggtaacttaccggttttacgggaccggtaaaccgggggtaaccaaacggtcggttaacggggaaacaacgttaaccgaaaaacggtaccgttaggtaacggtaccgttacggacctaaccgtaactttccgtacgtttacccg

SEQ ID NO: 392000 - DNA, 624 bp, Homo sapiens
  misc_feature: GZ8MTXP02FV3HB.39.81.H04.1.454.CMB.2.raw
  modified_base (274)..(274): a, c, t, g, unknown or other
  modified_base (345)..(345): a, c, t, g, unknown or other
  modified_base (428)..(428): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttgagtggatgggatggatcgagcgcttaacaatggtcacacaaacgtntgccacacgaactccgaggcagcgtcaccatcgaccacacgacacactcccagacgacgacgcctacagtcgacctgaggacnccgtaggacgacttcgacggaaccgaccgtacgggtacccgttgttaacgttacgtggtcgaccggtaaggaggtaaggttaccgggggtaaaatttacggtttttacgaccgtttacggttaacccccgttgtttttacggaacccgtttaacggtcgggggttaccccgaacgggggttaaccccttaccgggg

SEQ ID NO: 392001 - DNA, 749 bp, Homo sapiens
  misc_feature: GZ8MTXP02ID5KB.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctcgccccgtcacccgttggacacgcccggcctccatcctcctgctaggtctagtacaaacgtcctcgtatactattgaatacggaaactactacttagtaaatttggttacagcgagacggccaaggccaaatccgtaccgaaggccgtaccttaaattttaacgtaacggttttaccgtaaacccggggtactccggtacggggtaccccaaggactacgaacttccgaggccggtacgtagggttggggtcgacgggactacgttagtaaacgttcaaactaactaagtaaaactcgaagacggaagggggtggaggtacgtaggagggtagttagggtttagggggtttaatttacgtacgtagtaagttacggaacgtaaaacgggaacctaacgtacggttaccggtaccccgtttaccggtaaccgtttaccggtttttaccggggaacccggtaacgggggttaaacccgaacgttacgggaacgggttaacgaaaccgttaaccgtaaaaacggtaacgttcgggtaacggtccgtacgtacccgtaaccgttaacgtttaccg

SEQ ID NO: 392002 - DNA, 605 bp, Homo sapiens
  misc_feature: GZ8MTXP02HFW6F.39.81.H04.1.454.CMB.2.raw
  modified_base (285)..(285): a, c, t, g, unknown or other
  modified_base (287)..(287): a, c, t, g, unknown or other
  modified_base (293)..(293): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggatgttgtgatgactcagtctccagtctccctgcccgtcacccttggacacgccggcctccatctcctgcaggtctagtcaaagcctcgtatacattgataggaaacacctacttgaattggttcagcagagcagccaancncaggcnctaatttataaggttcaaccgggatcgtcggggtcccagacagacttcgagtcggctaggtcgggtcgagggcctaacgtggtaaacttcaactactaagaaaactcgaagacgagggggtggaaggcgtaggaggtagttgggttagggtttattacgtgtacgagttgaacgtaaacgggaaactacgacgtacggacccgttaccgttaacgtaccgttttacgggaccgtaacgggggacccaggtaccgtaggagaacgtaacggtaaaactacggtggtacggctacgacgacctagtcctttacg

SEQ ID NO: 392003 - DNA, 675 bp, Homo sapiens
  misc_feature: GZ8MTXP02F9R7G.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacgacggcccctggacaagggcttggagtggatgggatggatcgagcgtcttaacaagtcggtacaacaacgaaaactatcgaccaacgagaaccctccgagggcaagcgtacaaccgatacgaccaacgagaaccacactacccacgacgccgaaccgacctacgagtacgggactaggacggacgacctggaacgtagttcaggaccgaccgacgggtcccgttagttaacgttacgtggtacggacggtaacggaacgggtaggttaacgggggtaaaatttacggttttacgggaaccgtttacgggtttaaccccctttggttttacggtaaacccggtttacgggtaccgggggtacccggtaaaccgggggtaaccccgtttaccgggg

SEQ ID NO: 392004 - DNA, 601 bp, Homo sapiens
  misc_feature: GZ8MTXP02J006X.39.81.H04.1.454.CMB.2.raw
  modified_base (369)..(369): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcaacaacaaactatgccacagaaccctccaggggcaggngtcaaccatgaccacagaccacactaccacgacgaccgacgcctacacgtacggacccgtagaggacgcctaggagatcgtacgaaccgacgaccggtaccgtaggtactttacgtagtagcgaaggacggaaggtacggggtaaaattacgtttagaaccgttcgggttaacccctcgttttacggaacgttaccggtacgggggtacccgtaacggggtaacccctcggg

SEQ ID NO: 392005 - DNA, 627 bp, Homo sapiens
  misc_feature: GZ8MTXP02I0X04.39.81.H04.1.454.CMB.2.raw
  modified_base (344)..(344): a, c, t, g, unknown or other
  modified_base (369)..(369): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggagtgggatggatcgagcgcttacaatggtcacacaaactntgaccacacgaacctcgaggacagngtcaccatcgaccacacgacaacactaccacgactacacgacctaccatcggacctggagtacgacctgaagtatccgtaggaaccgaaccgacgggtacccgttagttaacgttaccgtggtacggaccggtaacggaacggtaggttaaaccgggggtaaaatttacggttttacgaaaccgttcggttaacccccgttgtttacgaaccgtttaccggtacgggggtaccctacgggggtaaaccctttccgggg

SEQ ID NO: 392006 - DNA, 702 bp, Homo sapiens
  misc_feature: GZ8MTXP02JVL71.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaactatggtatcaggttgggtgcgacgacggcccctggaccgaagggtcttggaggttggagtgggatggatcgagtcgtacttaacaagtcggtacaaacaacaaaactatacgaccccacgaacgtaacccctaccggaggggaccaaggcgtaccaaccgtagtacgaacccaacgaagtaaacccaacgaactacccgaaacgacggacccaaccgggtacccaacgagtaccggaaccgtggaacggacgccgtaggacgacgtcgtacgggaaccgaccgaccggtccgttagttaacgttacgtggtacggacggtaggacgggtaacgggtaacgggtaaatttacggttttacggaccgtttaccggtttacccgttaacgtttacgtaacggttaccgggtaccggggtaacccggaaccggggtaacccgtccgg

SEQ ID NO: 392007 - DNA, 682 bp, Homo sapiens
  misc_feature: GZ8MTXP02IO3ZG.39.81.H04.1.454.CMB.2.raw
  modified_base (215)..(215): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttctggttacacctttaaccaactatggtatcgagttgggtgcgacacggcccctggaacaagggcttggagtggagtgggatggatcgaggcgtacttacaagttggtacaacgaacaaaactatcgaccaacaacgaaccctccgaggaccagacgtacaacgatacgaacccagaacgaccactaacacccgaacgacgaccgaaccgggtaccctaacgaacgttacgggacccgtaggaacgggacgtacccgtaggaacgtagtaccgtacggaacccgacggtaacccgggtacgttacggtaaactttaccggtgtacggacggtaagaacggtacggtaacggggtaaaatttacggttttacgaccgtttacggttaacccgttcgttacgtaacgttaccggtacggggtaccgtaacggggtacccgttacggg

SEQ ID NO: 392008 - DNA, 673 bp, Homo sapiens
  misc_feature: GZ8MTXP02HD2HI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaatatggtatcagttggtgcgacaggcccctggacaaggcttgagtggagtgggatggatcgagcgtacttaacaagtcggtacaacaacgtaaactagtgacccaacacgaaaccctccgaggggacaaggcgtacaacagtacgaccaacacgaaccacactacccaacgacgaccaaccggtacctaacgacgtacggaacccagggaacggacgcccgtaggaacgtacgttaccgtacggaaacccggaaccgtaaccgggtccggtttagtaacgtttaccggtggtacggacggtaaggaggtaggtaacgggggtaaaattacgttttacgaaccgttacggttaacccgtttaacgtttacggaaccgttacggtaccggggtacccgtaacggggtaacccgtttccggg

SEQ ID NO: 392009 - DNA, 593 bp, Homo sapiens
  misc_feature: GZ8MTXP02INWQV.39.81.H04.1.454.CMB.2.raw
  modified_base (396)..(396): a, c, t, g, unknown or other
  modified_base (461)..(461): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatgtatcagttggtgcgacaggcccctggacaagggcttggagtggagtgggatggatcgagcgtattacgaatggtacacaacaaactatcgaccacacgaaaccctcgaagggacaagcgtccacagtacacccanagacacacacccaacgacgcgaccggacctacacgtacggaacctggacggacgcctagaacgtntccgtagaccgaccgacggtaccgttagtaacttcgtgtgacgagacggtagtaacggggttaaaattcgtttacgacgttcgttaccgttgttacgacgttacggtcggggaccgtacgggaacccttcgg

SEQ ID NO: 392010 - DNA, 606 bp, Homo sapiens
  misc_feature: GZ8MTXP02JH2OZ.39.81.H04.1.454.CMB.2.raw
  modified_base (402)..(402): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacacggcccctggacaagggcttggagtggagtgggatggatcgaggcgtcttaacaagtcggtacaacaacaaactatcgaccaacacgaaccctccgagggacagcgtcaacatcgaaccanacgacacactaccacgacgacgaccgacctacacgtacggacgacgacggacgccgtagacgacgtcgtacgaacgaccgacggtaccgtacgtacgttacgtgtagacggacgagaggtacgtaaaggggggttatttacgtacgttacgtaccgttaacgttacgtacgtacggtacgggtaccggtacggtaccgtaccgg

SEQ ID NO: 392011 - DNA, 715 bp, Homo sapiens
  misc_feature: GZ8MTXP02HNIJJ.39.81.H04.1.454.CMB.2.raw
  modified_base (239)..(239): a, c, t, g, unknown or other
  modified_base (356)..(356): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttntggtactaccttacaactatggtatcagttgggtgcgacacggcccctggacaagggcttggagtggagtggggatgggatcgagcgtacttacaagtggtacaacgaacaaaactntcgaccacaacgaaccctccgagggcaaggacgtcaacatcgaaccacaacgaccacacaccgaacgacgccacggtaccctacagtacggaccctaggaacgggacgtaccgtagacgtaagttccgtacggaaaccggaaccgaacccggggtacccgttaggttaaaccgtttaaccggtgggttacggaaccggtaacgggaaacgggttaaggttaaaccgggggtaaaatttacggtttttacgggaccgtttaacccggggtttaacccctttaacggttttacggtaacccgtttaacggggtaccgggggtaaccccgtaaccgggggtttaaacccccgtttcccgggg

SEQ ID NO: 392012 - DNA, 567 bp, Homo sapiens
  misc_feature: GZ8MTXP02JKR1N.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacactacttgaattggttcagcagaggccaggccaatcaccaaggcacctaatttataaggtttcaaccgggctcgtggggtcccagacagattccgagcggcaggtggcaggcactgaatcacactagaaaatcagcgaggggtggaggcgtagaggagttgggtttagggtttattacgtgactagtagacgaaaggaacacacgtcggacccgttaccgtacttacgtttacggaccgaacggggaccaaggcgtaggaacgaacgtacgaaaacgtacgtaggtaacggctacggacaccgtactccgtcgtttacc

SEQ ID NO: 392013 - DNA, 638 bp, Homo sapiens
  misc_feature: GZ8MTXP02HOV7W.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcgagcgcttacatggtacaacaacaaactatgacccaacacgaaccctcgagggccagacgtcaaccagtcgaaccacgaacgaaccacactacccgaacgacgaccaaccggaccctaacgacgtacggacctaggaacggacgacccgtagaacgtactcgacgaacgaccgacggccgttagtaacttacgtgtacgcggaggaggtacggtacggggtaaatttacgttttacgacgtttaccggttaccctttaacgtttaacggtacgtttaaccggtcggggtacccgtaaaccggggtaacccgtttaccggg

SEQ ID NO: 392014 - DNA, 536 bp, Homo sapiens
  misc_feature: GZ8MTXP02IORV5.39.81.H04.1.454.CMB.2.raw
  modified_base (387)..(387): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagcgtcaccatcgaccacagacacanccacgagcacgctacatggacctgagagcctgagatctagacgacgacggccgtgtattacgtgtgcgtagagagtacggggtaaattgtttacgacttcggtacccttgttcgtacgtacgtcgggtaccgtaacggggtaccctcgg

SEQ ID NO: 392015 - DNA, 542 bp, Homo sapiens
  misc_feature: GZ8MTXP02GXXQT.39.81.H04.1.454.CMB.2.raw
tcagtcgcactagtcacgaccggtgctcgatttagtagtgtagattcgcgggggatcaggactcctcatttcaccttctcacaatgaggctccctgctcagctcctggggctgctaatgctctgggtcccaggatccagtggggatgttgtgatgactcagtctccagtctccctgcccgtcacccttggacagccgcctcatctcctgcaggtctagtcaaagcctcgtatacattgatggaaacacctacttgaattggttcagcagaggccaggccaatctccaaggcacctaatttataaggtttctaaccggctcgtgggtcccagacagatccgagcgcaggtggcaggcatgaattcacactagaaaactcgagcgagggtggaggcgtaggaggtagttggtttaggggtttattacgtagctagtgacgaaggacacgacgtgaccctacgtacgtacgtttggacgtacggggacaagcgtacggagactacgaaaacgacgtggtaagctacgacacctacgtctgttacc

SEQ ID NO: 392016 - DNA, 605 bp, Homo sapiens
  misc_feature: GZ8MTXP02FP2TG.39.81.H04.1.454.CMB.2.raw
  modified_base (372)..(372): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctgtatacattgataggaaacacctacttgaattggttcagcagacgccagccaatctccgaaggcgtaccttaatttagtaacggtttacgtaaccggactcgtcggggtccagacagtatcgagcggctaggtcgggtnacggcacgtagacttacacgactagaaatcagacgaggggtcggaggcgtaggaggtagttggttagggtttagttacgtgacgagttggaacgaaggaacactacgtcgtaccgttaccggtacctacgtttcggaccggtaacggggtaaccaacggtcgttagggaacgtaacgtaaccgtaaaacggtaacgtcggtaacggtccgtacgaccgaccttaacgtttccg

SEQ ID NO: 392017 - DNA, 623 bp, Homo sapiens
  misc_feature: GZ8MTXP02HYFQA.39.81.H04.1.454.CMB.2.raw
  modified_base (265)..(265): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaagtctctgcaagctctgtacaccttacaatatgtatcgagttggngcgacacgccctggacaaggctgagtggatggatggatcgagcgacttaacaagttggtacaacaaacaaaaactatcgaccaacgaaacgaaacccctccgaaggggaccaaggacgtccaaaccctagtcgaaacccaacaagaaccaactaatacccaacgagacgaaaccgtacctaacgagtacggaacctggaaggaagccttagaagattcgacgaaaccgacgacgggaccgttagtaattacgtggcgacgaaggaagtaaggtaaacgggtaaaatttagtttacgaacgttacggttacccttgtttacgaacgttacggtcgggacccgtaacgggtaaccctcgg

SEQ ID NO: 392018 - DNA, 555 bp, Homo sapiens
  misc_feature: GZ8MTXP02FGVRK.39.81.H04.1.454.CMB.2.raw
  modified_base (389)..(389): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagaggccaggccaaatctccaaaggcgacctaaatttataaggtttcctaaaccgggactcgtggggtccagacagattcagcggcagtgggtcaggcactgaacttcaacactanaaaatcaagcaggggtaggaggctagaggtagttaggttaggggtttattacgtgcatgacaaggaacacacgtcgcctaccgtactacgtttacggaccgaacgggggaccaacgcgtaggaagactaacgaaaacgtaacgtgtacggctacgacaccactccg

SEQ ID NO: 392019 - DNA, 557 bp, Homo sapiens
  misc_feature: GZ8MTXP02JEW6J.39.81.H04.1.454.CMB.2.raw
  modified_base (466)..(466): a, c, t, g, unknown or other
  modified_base (469)..(469): a, c, t, g, unknown or other
tcagtcgcactagtcacgaccggtgctcgatttagtagtgtagattcgcggggacccaaaaaccacacccctccttgggagaatcccctagatcacaactcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgacaccagaaccctccgagggcaggactcgaccatcgaccacagacacacaccacgagacgacggcctacagtcggacctggacgacgcctgagactctgacgacacggccgtagtattcgngtnacggagacgagtacggggaaattgttttaggacttacggtacccttgttgacttacggtcggggcctaacgggtacccgtggtacccg

SEQ ID NO: 392020 - DNA, 649 bp, Homo sapiens
  misc_feature: GZ8MTXP02FYYJU.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatggatggatcagcgcttacaatggtacaacaacaaaactatgacccaacacgaaccctccgagggaccaagtacgtccaaccaagtaccgaaccaacgagaaccacaactacccacgaacgaccaacggaccctaccgaagtacgggaaccctaggaacggaacggacccgtaggaacgtacgttaccgtacggaacccgaaccgaccgggtacccggttagttaacgttacgtggtcggacggaacggaggtagttacgggggtaaaattagttttacgaacgttcggttaccccttgtttacgaacgttacgtcggggtaccgtaacgggtaacccgtcgg

SEQ ID NO: 392021 - DNA, 556 bp, Homo sapiens
  misc_feature: GZ8MTXP02FFY2D.39.81.H04.1.454.CMB.2.raw
  modified_base (354)..(354): a, c, t, g, unknown or other
  modified_base (432)..(432): a, c, t, g, unknown or other
  modified_base (452)..(452): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctccaaggcgacctaatttataaaggtttctaaaccgggactcgtggggtcccagacagattccagcggnaggtggggtcagggcactgaaattcactactagaaaatcagcgaggggtgaggctgaggagttggttgggtttaattntgcagtgacgaaaggaacanaccgtggaccctcgtaccatttcgggaccgaaggggaccaaggcgtacggaagactacgaaaacgaacgtaggtggactacggaccaccgtataccgtgttacc

SEQ ID NO: 392022 - DNA, 569 bp, Homo sapiens
  misc_feature: GZ8MTXP02GL1Y5.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaaacactattgaattggttcagcagaggccaggccaatctaccaaggcgaccttaaatttataaggtttcaaccggactcgtgggtcccagacagtattcagcggcagtggtacagggcactgaattcacactagaaaatcagcgagggtggagcgtagaggtagtgggtttgggttatacgtgacgtagtcgagaaaggacacgtaacgtcggaccttcgttaacgtcgtttcgggaccgtacgggggaaacctaggtacgtacggaagtacgtaaccgaaaacgtaacgtggtaacggctacggacacacggttctacgtttcc

SEQ ID NO: 392023 - DNA, 633 bp, Homo sapiens
  misc_feature: GZ8MTXP02IFJ3G.39.81.H04.1.454.CMB.2.raw
  modified_base (524)..(524): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcagttgggtgcgacaggcccctggacaagggcttgagtggatgggatggatcgagcgtacttacaagtggtacaacgaacaaaactatcgaccaacacgaaccctcgaagggcaagacgtaccaaccatacgaacccacaacgaccaacacacccgaacgacgaccgaaccggaccctaaccagtacggaaccctggaacggacgccgtaggacgtactcgtacggaccgaccgacgggtccgttaggttaattacgngtacgacgaaggagaggtacgggtaaaattacgttttacgacgtttcggttaacccttgtttacgaacgttacgggacggggtacccgtaacgggtaaccccgttcggg

SEQ ID NO: 392024 - DNA, 664 bp, Homo sapiens
  misc_feature: GZ8MTXP02G4K4M.39.81.H04.1.454.CMB.2.raw
  modified_base (357)..(357): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcaggttgggtgcgacacggcccctgggacaagggtcttggagtggagtgggatggatcgagtcgcttacgaagtggtacacaactaaactntcgacccaacacgaacctcgagggcaggcgtcacatcgaccacagacacactccacgacgacacgacctacgagtcggacctggaacggacgccgtagacgtactcgtacggaaccgaacgtaccggtaccgttagtacttaaccgtggtacgaccggaaaggtaacggtaacggttaaaccgggggttaaaatttacggtttttacggaaaccggtttaccgggtttaaccccttaacggttttacggaaccggtttaaccggtccgggggtacccggtaaaccgggggtaacccccgtttacggg

SEQ ID NO: 392025 - DNA, 633 bp, Homo sapiens
  misc_feature: GZ8MTXP02FN8EZ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggcccctggacaaggcttgagtggatggatggatcgagcgtcttaacaagtggtacaacaacaaaactatcgacctaacgaacgaaacctccgaaggggcaagacgtacaccatacgaacccaagacgaacacactacccaacgacgcgtaaccggcctaacatcggaccaggagagtccagagtatctaggaaccgaccgaacggtccgttagttaacgtactgtacggacggaaacgtaggaacggttaacggggtaaaattacggtttttacgaccgttacgggttaaccccttgtttacgaacgttaacggtccgggggaacccgtaacggggtaacccgtttccggg

SEQ ID NO: 392026 - DNA, 839 bp, Homo sapiens
  misc_feature: GZ8MTXP02GM5UY.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctcgtatacattgataggaaacacctattagaatttggttcagcagacggaccaggccaatcctaccaaagggcctaccttaaatttaacgtaacggttttaccgtaaaacccgggtacttccggttacgggggtacccctaaggaaccgtaaggtactttccccgaaacggtccgggacgtaagggttcggggtaccaagggccgtaacgtacgtaaactttaccgaactaaacgttaacgaaaaactccgaaagtaccggaagggggtacgggaagggtaccgttagggaaaggggttaaggtttagggggttttagggggtttttaaacgtttaccggttaagggtaccgttaaacggttaagggtaaaccgaaaaacggggtaaaccaaccgtaaacccggttcgggtacccccgtttaaacccggtttaaacccgtttaccggtttttaccgggggaaccccggttaaaacggggggaaaccccgtaaaacgggtaccggttaacggggtaaacggaaaacgttacccgaaaaaaccgggtaccgttaagggtaacgggtaccttacggacccgtaaacccgtatttcccgttacggtttaacccc

SEQ ID NO: 392027 - DNA, 691 bp, Homo sapiens
  misc_feature: GZ8MTXP02GMS8Y.39.81.H04.1.454.CMB.2.raw
  modified_base (410)..(410): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatcctcctgctaggtctagtacaaacgtcctacgtatactattagagtaacggaaaacctaccttacttagtaagtttggttacagaccaaggacggccgaggacctaatcctaccgaaggcctacctttaaatttaagttaacggtttaccgaaacccgggtctcggtcgggtacccagactagacttcgagcgacaggttggacngggctaacgtagtaaacttccaaactacgttaaagaaaactcgaacgaggtaagggtagggaaggtcgtaggaaagggtagtttaggggtttaggggtttaattaacggtgtaacgtaaggttaggaacgtaaaagggaaaccaaccgtacgtacgggtaccccttaccgttaccttaacggttttcggaacccggtaaacggggaaccaaagtcggtaggaaacgtactaaaccgaaaacgtaacgttggtacgtaccgacgaccacctactcgtttacg

SEQ ID NO: 392028 - DNA, 609 bp, Homo sapiens
  misc_feature: GZ8MTXP02GNDSJ.39.81.H04.1.454.CMB.2.raw
  modified_base (349)..(349): a, c, t, g, unknown or other
  modified_base (374)..(374): a, c, t, g, unknown or other
  modified_base (389)..(389): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgacttacaagtggtacacaacaaactntgaccacagaacctccgagggcagngtcaccatcgaccanagacacatacccacgacgacaccggtaccctacacgtacggaccctaggacggaacgcccgtaggacgtataccgtaggaaccgaccgaacgggtccgtagttacttacgtggtacgacgtaggacggtaggttacggggtaaaattcgttttacgacgttacggttacccttcgtttacgtacgttacggtcggggaccctacggggtaacccttcggg

SEQ ID NO: 392029 - DNA, 602 bp, Homo sapiens
  misc_feature: GZ8MTXP02JOL8F.39.81.H04.1.454.CMB.2.raw
  modified_base (354)..(354): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgaggttgggtgcgacacggcccctggacaagggcttgagtggagtgggatggatcgagcgtacttaacagtggtacacgaacaaactntagaccacacgaaccctccgagggacagcgtcaaccatacgaaccacgacgacacactacccacgacgcaccggacctacgagtcggaccgtggggacgcctgagctcgaggaccgacgaccgggtcgtacgtagttacgtgtagacggagtaaggtagtacgggggtaaaattgtttacggacgttaccggttaccttacgttgaacgttacggtcggggaccgaacgggtaacccgttggtacccg

SEQ ID NO: 392030 - DNA, 554 bp, Homo sapiens
  misc_feature: GZ8MTXP02H5ZH5.39.81.H04.1.454.CMB.2.raw
  modified_base (368)..(368): a, c, t, g, unknown or other
  modified_base (389)..(389): a, c, t, g, unknown or other
  modified_base (452)..(452): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttacaactatggtatcagttgggtgcgacaggcccctggacaagggcttgagtggatgggatggatcgagcgtcttaacatggtcacaacaaactatgccaacagacctcgaggcagngtcacatgaccacagacacanccacgacgacacgcctacatggacctgagagcctgagatcagacgacacggctgtacttacgngtgcgagagagtacggggtaaattcgttttagacgtttacggtaacccttcgttttacggaacttacggttacgggggaccctaacgggggtaacccctcgg

SEQ ID NO: 392031 - DNA, 607 bp, Homo sapiens
  misc_feature: GZ8MTXP02HE1ZL.39.81.H04.1.454.CMB.2.raw
  modified_base (372)..(372): a, c, t, g, unknown or other
  modified_base (395)..(395): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacactattgaattggttacagcagacggccaggccaatctacaaggcgaccttaaatttagtaacggtttctaaacccgggacttcgtcggggtacccagacagacttacagcgcgaggtggtcngggcaactgaaacttcaactaanagaaaatcgaagcgaaggggtggaggcgtaggaaggtagttaggtttaggggtttattacgtaggacagtgaacgaaagggaactacgaacgttcggacccgttaccgtacgttaccgtttacgggacccggtaacgggggaacccaaaggtcgtaaggaacgacgtaacgaaaacgtaacgtggtacggactacgaccacctattccgtag

SEQ ID NO: 392032 - DNA, 620 bp, Homo sapiens
  misc_feature: GZ8MTXP02GGKE6.39.81.H04.1.454.CMB.2.raw
  modified_base (319)..(319): a, c, t, g, unknown or other
  modified_base (346)..(346): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttggtgcgacacggcccctggacaagggcttgagtggatgggatggatnagcgcttacatggtacaacacaaactntcgacaacacgaaccctcgaaggggcaggacgtaccaaccatacgaaccaacgaacgaaccaacaacctcccgaaacggacgacccgaaccgggtccctaacgaagtccgggaaccctagggaacgggacgccgtaggacgtactacgtacgaaccgacgaccgggtccgttagtacttacgtgtagacgagacggtaggtaacgggtaaatttcgtttacgacgttacggtaacccttgttacgacgtacggtcgggaccgtacggtaacccg

SEQ ID NO: 392033 - DNA, 708 bp, Homo sapiens
  misc_feature: GZ8MTXP02IRYX5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttacaatatggtatcagttgggtgcgacacggcccctggacagggtcttggaggtggagtgggatggatcgaggcgtacttaacaagttggtacaacaaacaaactatcgaccacgaacgaacctccgagggacagacgtccaaccagtacgaccaacacgaaaccacactacccgaacgacgaccgaccggtaccctacgaacgtcgggaaccgtaggacgggacgtacccgtaggaacggtacttacgacgggaacccgtaaccggacccgggtaccggtttagttaaactttaccggtgggtacggaacggtaagggtaacggtaaacgggtttaaaccgggggtaaaaattttggttttaccgtaaccggtttaccgggtttaacccctttggtttaacggtaaccgttacggggttaccgggggacccgtaaccgggggtaacccctttccgggg

SEQ ID NO: 392034 - DNA, 590 bp, Homo sapiens
  misc_feature: GZ8MTXP02FSV92.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctcgtatacattgataggaaacactacttgaattggttcagcagacggccaggccaatcctacaaggctacctaatttataaggtttacaaccggcttcgtacggggtcccagacagacttcagcgcaggtggtcagcatgaattcacactagaaatcagcgagggtgaggcgtaggaggtagttgggttagggtttaatacgtgtcagtacggaacgaaacggaaactacgaacgttcggaccccgtaccgttaacgtacggtttcgggaaccggtacgggggtaaccaaaggtccgttaaggaacggtaactacgaaaaacgtaacgttggtcggacttaggaccaacgtacttccg

SEQ ID NO: 392035 - DNA, 592 bp, Homo sapiens
  misc_feature: GZ8MTXP02HF24C.39.81.H04.1.454.CMB.2.raw
  modified_base (377)..(377): a, c, t, g, unknown or other
  modified_base (386)..(386): a, c, t, g, unknown or other
  modified_base (401)..(401): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggacaagggcttgagtggatggggatggatcgagcgcttaacaatggtcaacgaacaaactatgacccacacgaaccctcgaggcagngtccaacancgaccacagacacanaccagacgcacgacctacagtcggacctaggacgacgcctaggacgtactacgacgaccgaacgaccggccgtagtacttacgtgtagacgagagaggtacggggtaaaattgttttacgacgttcggttaacccttcgtttacggtaacgttaccggtacggggacccggtaacgggtaacccgttccgg

SEQ ID NO: 392036 - DNA, 582 bp, Homo sapiens
  misc_feature: GZ8MTXP02GDOD2.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgataggaaacacctacttgaattggttcagcagaggccaggccaatctaccgaagcgtactaatttataaggtttcaaccgggctcgtagggtcccagacagtacttcgagcggcaggtgggtcagggcaacgtgaaattccgaactactaagaaaatcgaagacgaggggtaggaggcgtaggaggtagttagggtttaggggtttaattacgtgacgtagtagacgaaacggaacacgaacgtcggaccctaccgtacgtacgtttacggaccgaaggggaccaaggcgtacggagtaactacgaaacgaacgtggtacggactacgacacctacttcg

SEQ ID NO: 392037 - DNA, 616 bp, Homo sapiens
  misc_feature: GZ8MTXP02HA166.39.81.H04.1.454.CMB.2.raw
  modified_base (519)..(519): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgtacttacaagtggtacacaacaactatcgaccacagaaccctccgaagggccaagacgtccaaccatacgaacccaacacgaaccaacactacccaacgacgaccgaacccggacctacaacgtacgggacccaggaacggtacgcccgttaggaacggtatccgacgggaaccgaccgaccggtccgtagtattacgngtgacgagacgtaggtacgggaaattgttcgtaacgtcggttaaccccttgtttacgaccgttacggtcggggaaccctacggggtaacccttcggg

SEQ ID NO: 392038 - DNA, 606 bp, Homo sapiens
  misc_feature: GZ8MTXP02JUERU.39.81.H04.1.454.CMB.2.raw
  modified_base (370)..(370): a, c, t, g, unknown or other
  modified_base (397)..(397): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggaccaagggcttggagtggagtgggatggatcgagcgacttaacaagtggtacaacaactaaactatgaccacacgaccncgagggacagcgtccacgatcgaccanacgaccacactccacgacgccgtaccggacctacgagtacggaccgtaggacggacgccgtaggaagacgttacgacggaaccgaccgaccgggtacccgttaggtactttaccgtggtagcggaaggtaggaaaggtacggggtaaattagtttacgacgttcggttaccttgttacgactacggtacgggaccgacgggtacgtcgg

SEQ ID NO: 392039 - DNA, 616 bp, Homo sapiens
  misc_feature: GZ8MTXP02JY48K.39.81.H04.1.454.CMB.2.raw
  modified_base (274)..(274): a, c, t, g, unknown or other
  modified_base (344)..(344): a, c, t, g, unknown or other
  modified_base (369)..(369): a, c, t, g, unknown or other
  modified_base (399)..(399): a, c, t, g, unknown or other
  modified_base (433)..(433): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttgagtggatgggatggatcagcgcttacaatcggtacacacaaactntgacccacagaacctcgagggcagngtcaaccatgaccacagacacatccacgancacgcctacacgtggacctgacgagccgagagtntcgagaccgacgaccgggtaccgttggtaacttaccgtgtacggaccggtaaggaaggtacggttacgggggtaaaattacgtttttacggaaccgtttacggggttaacccccttaaggttttacggtaaaccgttaacggtccgggggtacccgtaaacgggggtaacccccgtttcgggg

SEQ ID NO: 392040 - DNA, 676 bp, Homo sapiens
  misc_feature: GZ8MTXP02GYF48.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacaccttaccaactatggtatcagttgggtgcgacgaggcccctggacaaggcttgagtggagtgggatggatcgagcgtacttaacaagttcggtacaacaaactaaactatcgaccacaacgaaccctccgaaggggctaagacgtcaaccatacgaaccacgagacctaacactacccgacgacgaccacggacctaacacgtacggacctaggacggacgaccgtagacgtatccgtagaaccgaccgaccggtacgttacgtaagttaaccgtggtacgacggtaaaggtacgtaacgggttaaacggggtaaaagttttacgtttacgggtaacccgtttaccggttaaccccgtttgttttaccggaacccgttaccggtaccgggggtaacccgttaaaccgggggtaccccgtttacccgggg

SEQ ID NO: 392041 - DNA, 636 bp, Homo sapiens
  misc_feature: GZ8MTXP02GVX5Z.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtgcgacaggcccctggacaagggcttgagtggatgggatggatcgagcgtcttaacgaatggtacaacgaacaaaactagtacgaccaacgaacgaaaccctaccgaaggggcaaggacgtccaaccagtacgaacccaacagaccaacactacccgaacgacgaccgaaccggaccctaacacgtcggaaccgtggaacggagccgtaggacgagtctaggaccgaacgacggccgttagtaacttacgtgtgacggaagaggagttaacgggggtaaaattacgtttacgacgttacgggttaacccttgtttacggaacgttaccggtacggggtacccgtaacggggtaacccgttcggg

SEQ ID NO: 392042 - DNA, 555 bp, Homo sapiens
  misc_feature: GZ8MTXP02FNJT6.39.81.H04.1.454.CMB.2.raw
  modified_base (249)..(249): a, c, t, g, unknown or other
  modified_base (362)..(362): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctacttgaattggttcagcagaggccaggccaatctccaaggcgcctaatttataaggtttctaaccggggactcgtggggtcccagacagacttcagcggcaggtgggtcnggcactgaaattcaacactagaaaatcgaagcgaggggtggaaggctaggaggtagttggttagggggtttattacgttgactagtgacaaagggaacacgacgtggcctcgtactacgtttggaccgtagggaccaaagcgtaggacgactacgaaacgtaacgtggtcggactacggacacacgtcttacg

SEQ ID NO: 392043 - DNA, 633 bp, Homo sapiens
  misc_feature: GZ8MTXP02F02RN.39.81.H04.1.454.CMB.2.raw
  modified_base (322)..(322): a, c, t, g, unknown or other
  modified_base (538)..(538): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacaggcccctggacaagggcttggagtggagtgggatggattcgngcgtactaagtagtcgacaacaaactaatagtacgacccaacgaaccgtaaccgtacggacggacgaacgtaccgaccaacgtacgtaccgaaccaacgacgaaccaactaccgaccgacgacgaccggaccgtacccacgtacgtaccggacgagggacgaccgtcgagaacgtcgtacgacggaacgaccggacggtaccgtagttacgtacgnggtacgagtaaggtacggtagggtaaacggttaatttacgttacgtacgtccgttacttgtacgtacgtcggtacggacggtaccggacgttccg

SEQ ID NO: 392044 - DNA, 623 bp, Homo sapiens
  misc_feature: GZ8MTXP02F2MY3.39.81.H04.1.454.CMB.2.raw
  modified_base (349)..(349): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggttcagcagagccaggccaatctccaaggcgacctaatttataaggtttctaaccgggactcgtggggtcccagacagattccagcgnagtggtcagggcactgaattcacatagaaaatcagcgaggggtggaggctaggaggtagttgggtttaggggtttaattacgttaggacaagttcggacgaaagggaaaccaacgaaccgtcgggtacccttaccggtaacttaccgttttacgggacccgtaacgggggtaacccaagggtccgttaggggaacgtaacgttaaccgaaaaaccggtacgttaggtaacggggtacttacggaccctaacctacgttaccgttcggtttaccc

SEQ ID NO: 392045 - DNA, 587 bp, Homo sapiens
  misc_feature: GZ8MTXP02FNJF2.39.81.H04.1.454.CMB.2.raw
  modified_base (348)..(348): a, c, t, g, unknown or other
  modified_base (464)..(464): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacttatggtatcagttggtgcgacaggcccctggacaaggcttgagtggatgggatggatcaacggtaacaggtggtctacaactaaaattangacacagaagtttcagggcaggggtcaccagtcgacgaggaccacgtcatacaatacagccacatagaactgagcatgctagagatcgtagacgacgacgccggtatattagttgnggacgaagagactggattaccgttcttacgttaacttacggttggggtttacgggggtaaagttttaaagtaacggttttcggttaccggtaccccggttacgggggaccctaaaaccggggg

SEQ ID NO: 392046 - DNA, 568 bp, Homo sapiens
  misc_feature: GZ8MTXP02I6N7H.39.81.H04.1.454.CMB.2.raw
  modified_base (358)..(358): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgataggaaacacctactgtaattggttcagcagacggccaggccaatctccaaggcgtaccttaatttagtaaggtttcctaaaccgggctcgtggggtcccagacagattcagcgnaggtgggtcagggcactgaattcacactagaaaatcagcgagggtgagcgtagaggtatgggtttgggtttattacgtgctagtcgacgaaaggaacacacgtacggtcctccgttaactcgtttcggaccgtacgggggaccaacggtccgtagggacgtaacgtaacgtaaacgaacgttaggtcggactcggaccactacgtttccg

SEQ ID NO: 392047 - DNA, 695 bp, Homo sapiens
  misc_feature: GZ8MTXP02J180E.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggggtgcgacacggcccctggacaagggcttggagtggatgggatggatcagcgacttacaagtggtacaacaacaaaactatcgaccaacgacgaaccctacgaggacctagacgtcaaccagacgaaccacaacgaccaacactacccgaacgacgacccgaaccggtaccctaacacgttacggaacccgttagggaacgggacgaccgtaggaacggtactacgacggaacgaccgtaccggggtaccgttagttaacttaccggtagtacggacgtaacggaaggtaccggttaaacgggggttaaaacttttacggttttacggaaccgttttacccggttaaccccgtttaacgtttaacggtaaccgttaccggggttaccgggggacccggtaaaccggggtacccgtttaccgggg

SEQ ID NO: 392048 - DNA, 559 bp, Homo sapiens
  misc_feature: GZ8MTXP02HDV7T.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgtcttaacaagtggtacaacaacaaactatgaccacagaacctcgaggcagcgtcacatcgaccacagacacatccacgagcacgcctacagtcgacctgaggagcctgagatcagaaccgacgacggccgtagtacttacgtgtcgacgtagagagtacggggaaaattcgtttacgacgttcggtaacccttgttacgaccgttacggtacggggaccgtacggggaacccttcggg

SEQ ID NO: 392049 - DNA, 629 bp, Homo sapiens
  misc_feature: GZ8MTXP02I2T5K.39.81.H04.1.454.CMB.2.raw
  modified_base (196)..(196): a, c, t, g, unknown or other
  modified_base (290)..(290): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacncgccggcctccatcctcctgcaggtctagtacaaagcctcgtatacattgataggaaacacctattgaattggttcagcagaggccaggccaanctaccaaggcgaccttaatttataggtttaccctaaccgggacttcgtggggtaccccagacacgattcgagcggcaggttcggtcgagggcacgtgaactttcgaactactagaaaatcagacgaggggtgaggctaggagtaagttgggttcgggtttaattacgtggctaagtggacgaaaggaaaccacgtaccgtggtacccgttaccgttacgtaccgttttcgggacccggtaacgggggtaccaaacgggtacggttagggaaacgtaacgttaacgaaaaacggtaacgttagggtcggtacgttcggaacccgtaccctagttttcccg

SEQ ID NO: 392050 - DNA, 569 bp, Homo sapiens
  misc_feature: GZ8MTXP02GIGVY.39.81.H04.1.454.CMB.2.raw
  modified_base (251)..(251): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctacgtatacattgatggaaacncctattgaattggttcagcagaggccaggccaatcctacaaggcaccttaatttataaggtttcaaccgggactcgtggggtccccagacagattcagcgcaggtcgggtcacgggcacgtgtaattccaacactagaaaatcgaggcgaggggtaggaggcgtaggaggtagtttgggtttaggggtttaattacgtgctagtagacgaagggtaacacgacgtcggcctaccgtactacgtttacggcgtacggggacaggcgtaggacgacgtacgaaacgtacgtgtacgtcgtacgtacactactacgtttcg

SEQ ID NO: 392051 - DNA, 576 bp, Homo sapiens
  misc_feature: GZ8MTXP02IVARC.39.81.H04.1.454.CMB.2.raw
  modified_base (395)..(395): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatcgagttggtgcgacacggcccctggacaagggcttgagtggatggatgatcagcgtcttacaatggtacacaacaaactatgacccaacacgaaccctccgagggccaggacgtcaaccatcgacccaanagaacacataccacgacgacacgacacatcgacctagaggacgccgtagagatctagaccgacgacggccgtagtaagttacgtgtgacgagagaggtacggggtaaaattagtttacgaacttcggttaacccttgtttacgacgttacgtacggggtaccgaacgggtacccgttacgg

SEQ ID NO: 392052 - DNA, 645 bp, Homo sapiens
  misc_feature: GZ8MTXP02GMG1R.39.81.H04.1.454.CMB.2.raw
  modified_base (399)..(399): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtcttaacaagtggtaccaacgaacaaaactatgaccaacacgaacctccgagggacagacgtcaaccatcgaaccanagaaccacactacccaacgacgacccaaccggaccctaacgagtacggacccgtagacggacgccctaggaacggtactacgtacggaccgaaccgaccgggaccgttagtaacttacgtgtacggacggaaggtaaggtacggtaacgggggtaaaatttagttttacgaaccgtttacgggttaaccccttgtttacgtaccgttacggtcggggtacccgtaacggggtaaccccgtttcggg

SEQ ID NO: 392053 - DNA, 687 bp, Homo sapiens
  misc_feature: GZ8MTXP02JIH5Q.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaaggcttgagtggatgggatggatcgagcgacttacaagtggtacaacaacaaaactatcgacctaacgaacgaaccctccgaggggaccaagacgtccaaccatacgaacccaacgacgaaccacactacccgaacgacgaccaacggacctaacgagtacggacctaggacggtacgacccgtaggaacgacgttaccgtagggaaccgaaccgacccgggtacccgttagttaacgttaaccgttgggtacgacgggtaaaggacgggtaaaggttaacgggggtaaaatttacggtttttacgaaaccggtttcggttaaaccccgtttgtttaacggtaaccgttaaccgggtcgggggtacccgttaacgggggtaaccccgtttccgggg

SEQ ID NO: 392054 - DNA, 632 bp, Homo sapiens
  misc_feature: GZ8MTXP02G8AFY.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacagggcttggagtggagtgggatggatcgaggcgtacttacaagttcggtactaaccgaactaaaactatcgacccaacacgaaaccctcggagggacaaggcgtaccaacagtacgaacccaacgagaacacactacccgagacgaccgacgacctaacacgtcggacctaggaacggacgccgtagagtactcgtacgaaccgaccgacggtaccgtagttaccgttagttcgagcggtaagacggtaggtaacggggtaaattacggtttacgaacgttcggttaaccttcgttacgtacgttacggtcggggtaccgtaccgggtacccgttacggg

SEQ ID NO: 392055 - DNA, 638 bp, Homo sapiens
  misc_feature: GZ8MTXP02FX49D.39.81.H04.1.454.CMB.2.raw
  modified_base (370)..(370): a, c, t, g, unknown or other
  modified_base (384)..(384): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggccctggacaaggctgagtggatgggatggatcgagcgcttacaagtggtacacaacaaactatgaccacacgaacctcgaggcagngtcacatcgaccanacgacacactaccacgacgacacgacctacacgtacggaccctagacgggagaccgtaggaacggactaccgtacggaaccgaacccaccgggggacccgttaggttaactttaccgtagtacggacggtaacggtaggaacggtaacgggggtaaaatttacgtttttacggaccgttcgggttaaccccttcgttttaccgtaaccgttacggtccgggggtacccgtaacgggggtaacccctttacgggg

SEQ ID NO: 392056 - DNA, 577 bp, Homo sapiens
  misc_feature: GZ8MTXP02HHJ15.39.81.H04.1.454.CMB.2.raw
  modified_base (351)..(351): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctgtatacattgataggaaactacctacttgtaattggttcagcagacgccagcatctcaaggcactaatttataacggtttctaaccgggactcgtcggggtccagacagatcgagcgnaggtgggcaggcagtagaacttcaactatagaaaatcgagcgaggggtgaggcgtaggaaggtagttaggttaggggtttaattacgtgactagtgacgaaaggtaacacgacgtcggccttacccgtacgtacgtttcggaccgacggggaccaacggtgtacggaacgtactaaaccgaaaacggtaaccgtaggtacggtacctacgacctaccgtacttccg

SEQ ID NO: 392057 - DNA, 666 bp, Homo sapiens
  misc_feature: GZ8MTXP02HV2QI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacagggcttgagtggatgggatggatcagcgtacttacgaattggtcaacaacaaaactatagacccaacaacgaaccctccgaggggccaagcgtcaacccatcgaaccacaacgaccacactcccaacgacgccaaccggtaccctaacgacgttacggggaaccctagggaacgggtaacgtcccgttaggaaagttaacgtcccgttacgggaacccggaccggaccgggtacccgttaggttaacctttacgtggtacggacggtaacggaggtaagggtaccgggggtaaaatttagttttcgaacgttcggttaacccttcgtttacgacgttacggtcgggggaccgtacgggggttaaccccgtcggg

SEQ ID NO: 392058 - DNA, 659 bp, Homo sapiens
  misc_feature: GZ8MTXP02JXP6V.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtacaaagcctgtatacattgataggaaactcctacttgaattggttacagcagacggccaggccaatcaccaaaggtccgtaccttaatttaacgtaaggtttccgtaaaaccgggtctccggtaggggtaccccaggaccagtattccgagcggctaggtgggtcagggcactagaacttcgaacactagaaaatcgagacgaggggtggaggtctaggaggtagttgggtttaggggttattacgtgctaagtggaacaaagggaaccacgtaccggttacggacccttaccgtaacgttaccggtttacgggacccggtaaacggggtaacccgtaaagggtccgtaaggggaacgtaaactaaccgggtaaaaccgtaacggttggtaacggaccgttacgacccgtaaacctacgtttccgtacggtttacccg

SEQ ID NO: 392059 - DNA, 573 bp, Homo sapiens
  misc_feature: GZ8MTXP02GW902.39.81.H04.1.454.CMB.2.raw
  modified_base (379)..(379): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaactacctacttgaattggtttcagcagaggccaggccaatctccgaggccgtactaatttataaggtttcaaaccgggacttcgtggggtcccagacagtatccagcgcaggtggcaggcactgaattcganactagaaaatcagcgagggtgaggctaggaggtagttggttagggttatacgtgcatgacgaagaacacgacgtacgccctacgtactacgtttacggaccgtaacggggaaccaaggcgtacggaaacgtaacgtaacgaaaaccgtaagttcggaaggtaccgtacggaccaaccgtacgtccttcgttacc

SEQ ID NO: 392060 - DNA, 671 bp, Homo sapiens
  misc_feature: GZ8MTXP02IELF8.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcaggttgggtgcgacacggcccctgggacaagggcttggagtggatggggatggatacgagcgtacttaacaagttcggtacaacaaacaaaacctatgacccaacaacgaaccctccgaaggggccaagcgtccaaccagtacgacccaacgagaaccaaccgactacccgaagacgacccaacccgggcccttaaccgagtaccgggaacctggaaggacgccgtaggaaggtatccgtaggaaccgacgaaccgggtccgttagtacgtttacgtggtacgacggtaaggaggacggttaacggggtaaaatttagttttacggaaccgtttcggttaaccccgttcgttttacgaaccgtttacggtccgggggtaccctaaacggggtaaccccttcggg

SEQ ID NO: 392061 - DNA, 680 bp, Homo sapiens
  misc_feature: GZ8MTXP02H3JUA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatggggatggatcagcgcttacaatggtcacaacaaactatgccaacacgaacctccgagggcaagcgtacaaccatcgaacccacaagaccaacactaccaacgacgccaaccgggaccctaacgacgtcggaaccctggaacggacgcctaggagtactcgtaggaaccgaaccgaccggggaccgttaggtaaactttaccgtaggtcggaccggaagtaacgggtaacggtttaacgggggtaaaacttttacggtttttacggtaaaccgtttaccggggtttaaccccctttaacgttttaccgggtaaaccgtttaaccgggttcggggggaacccccgtaacgggggttaaaacccccgtttcgggg

SEQ ID NO: 392062 - DNA, 620 bp, Homo sapiens
  misc_feature: GZ8MTXP02H3PPH.39.81.H04.1.454.CMB.2.raw
  modified_base (258)..(258): a, c, t, g, unknown or other
  modified_base (379)..(379): a, c, t, g, unknown or other
  modified_base (389)..(389): a, c, t, g, unknown or other
  modified_base (449)..(449): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactntggtatcaggttgggtgcgacacggcccctggacaagggcttgaggtggagtgggatggatcagcgtacttacaatcggtacacaacaaactatgaccaacacgaacctccgagggcaagngtccaaccancgaaccacagacacatacccacgagccacggacctacagtcggacctgagagcctgacgntacgagacgacgcggcgttagtacttacgtgtcgacggagaaggtaacggttacgggggtaaaatttaggttttacggtaacccgttacgggtttaccccctttaaggtttacggtaaaccgttacggggttaccgggggaacccgtacgggggtaaacccccgttcgggg

SEQ ID NO: 392063 - DNA, 608 bp, Homo sapiens
  misc_feature: GZ8MTXP02JPC8F.39.81.H04.1.454.CMB.2.raw
  modified_base (273)..(273): a, c, t, g, unknown or other
  modified_base (278)..(278): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatgtatcagttggncgacncggccctggacgaggctgagtggagtgggatggatcgagcgacttaacaagtggtacaacaacaaacgtatcgacacaagaaccctcgaggcacgacgtcaccgatacgaaccacagaaccacactccgaacgacgaccacggaccctagacgtacggacgtaggaggacgacgtagaacgtcgtacgacgaaccgacggaacgggtccgttagtaccttacgtggtcggaacggtaggaagtaaccgggtaacggggtaaatttacgttacgtaccgttacggtaacccttgttacgacgtacggtcggggaacccgaacggtacccgg

SEQ ID NO: 392064 - DNA, 635 bp, Homo sapiens
  misc_feature: GZ8MTXP02HH1MV.39.81.H04.1.454.CMB.2.raw
  modified_base (336)..(336): a, c, t, g, unknown or other
  modified_base (384)..(384): a, c, t, g, unknown or other
  modified_base (407)..(407): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttacaactatggtatcgaggttgggtgcgacgacggcccctggacaagggcttggagtggagtgggatggatcgagcgtacttaanaagtggtacacaacaaactatgacccaacacgaacctcgaggccagcncacatacgaccagacgacacacnccaacgagaccacgctaacgacgtacggacccaggacggacgtacccgtaggacgtactaccgtacgggaaaccgtaccggaccggtaccgttagttaacttaccgtagggtacgacggaaggacggtaggtaacggggtaaatttacgtttacgacgtttaccggttaccccttgtttacgtaacgttacggggttacgggacccgtaacgggtaacccgttccggg

SEQ ID NO: 392065 - DNA, 620 bp, Homo sapiens
  misc_feature: GZ8MTXP02JBD61.39.81.H04.1.454.CMB.2.raw
  modified_base (277)..(277): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttggggtncgacaggcccctggacaagggcttgagtggatgggatggatcagcgcttaacaatggtcaacaacaaactatgaccacagaaccctccgagggccaagcgtcaacatcgaaccacgacgacacactaccacgacgacacggacctacgatacggactaggacggacgccgtagacgtactcgtaggaccgaccgaccggccgtagttaacgttacgtgtaggacggaaggacggtaggtaacgggggtaaaatttacgtttacgaacgttaccgggttaccccttgtttacggtaccgttaccggtacggggtacccgtaacgggggtaaccccgtttcgggg

SEQ ID NO: 392066 - DNA, 633 bp, Homo sapiens
  misc_feature: GZ8MTXP02GHDY4.39.81.H04.1.454.CMB.2.raw
  modified_base (251)..(251): a, c, t, g, unknown or other
  modified_base (282)..(282): a, c, t, g, unknown or other
  modified_base (287)..(287): a, c, t, g, unknown or other
  modified_base (306)..(306): a, c, t, g, unknown or other
  modified_base (322)..(322): a, c, t, g, unknown or other
  modified_base (340)..(340): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctcgtatacattgatggaaacncctatgattgttcagcagagccagccaatcncagcnctaattatagttcacgggntcgtgggtaccagacngactcagcgcagtggtcnggcagtagaaacttccaacacgtaaagaaaactcgagtacgaagggggtaggaaggggtacgtaggtaagggtagtttagggtttagggggttttattaacgtgactaagtacgaacgaaaggtaaccaaccgtacggtaccggtacccgttaacccggttaccgttaaccggttttcggggaaccccggtaacgggggtaaacccgaaaggtccggtaagggaaacgtacgtaaaccgaaaacgtaacggtaacgttcggaccgttacggaccgaccttacgtcctttaccg

SEQ ID NO: 392067 - DNA, 630 bp, Homo sapiens
  misc_feature: GZ8MTXP02IHFSF.39.81.H04.1.454.CMB.2.raw
  modified_base (355)..(355): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccctttaccaactatggtatcgtagttgggtgcgacacggcccctggacaagggcttggagtggagtgggatggatcgagcgacttacaagtggtaccacaacaaactntcgaccacgaacgaccctccgaggggccaggacgtccacgaatcgaccaacgagaaccaacactaccacgacgccaacggccctaacacgtcggacctaggacggaacgcccgtaggacggactcgtacggaaccgaccgaaccggtccgttagtacgttacgtgtcgacggtaacggagacggttacggggtaaattacgttttacgaacgttcggtacccttgtttacggtaaccgtacggtccggggaccgtaacgggtaacccgttccggg

SEQ ID NO: 392068 - DNA, 711 bp, Homo sapiens
  misc_feature: GZ8MTXP02JCR8L.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaacttatggtatcgtaggttgggtgcgacacggcccctggacaagggcttggagtggagtgggatggatcgagcgtacttacgaagttggtacaacaaacaaactagtcgacccaacaacgaaccctccgaggggaccaaggacgtccaaaccgtatacgaacccaacgacgaaaccaacacgtacccaaacggaacgaccgaacccgggtaccctaacgaacgttacgggaccgttacgggaacgggaccgaccgttaggaacggtaacttccggtaacgggaacccgaacgtaccggggtacccgtttaaggtaacgtttaccggtgtacggaccggtaaggaacgggtaaaggtaaccgggggtaaaatttacggtttacgaacggttaccgttaacccttgtttacggtaaccgtacgggttcggggacccgtaacggggtaacccgttcggg

SEQ ID NO: 392069 - DNA, 643 bp, Homo sapiens
  misc_feature: GZ8MTXP02JRT1U.39.81.H04.1.454.CMB.2.raw
  modified_base (250)..(250): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcaggtctagtcaaagcctcgtatacattgatggaaacnctatgaattggttcagcagagccaggccaatcacgaaggcactaatttataacggttcaaccgggctcgtgggtcccagacagtacttcgagcggacaggtcgggtacagggccacgtagaaacttccaacgtaactaagaaaactcgaaggtacgagggggtaggaggacgtagggaggttagttgggtttaggggtttaattacgtgtacgtagtaggacgaaacgggaactacgtaccggtcggtacccgtaccggttaaccgttacggttttaccgggaaccggtaaccgggggtaacccgaaaggtaccggtagggaaacgtaacgtaaaccgtaaaaccgtaacgttggacggtacgtacggacctaacccgtattacggtttaccg

SEQ ID NO: 392070 - DNA, 706 bp, Homo sapiens
  misc_feature: GZ8MTXP02G0VER.39.81.H04.1.454.CMB.2.raw
  modified_base (461)..(461): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaaggcttggagtggagtgggatgggatcgaagcgtacttaacgaagttcggtacaacaaactaaactagtgacccaacgacgaaccctccgaagggccaagcgtacactagacgaaccacgacgaacctaacactacccgaacgacgaccgaacccggtacctaaaccngtacggaacccgtaggaacggacgcccgtaggaagtacgttctacgggaaccgaaccgtaccgggtacccgtaggttaacttaccgtaggtacggaccggtaaggtaacggtaaggttaaaccgggggtaaaattttacgggtttacggtaaaccggtttaccggttaacccgtttcgtttacggtaaccgttacccggggttacggggaaccccggtaacgggggtaaaccccgtttcccgggg

SEQ ID NO: 392071 - DNA, 693 bp, Homo sapiens
  misc_feature: GZ8MTXP02IAR0T.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacctacctttacaacttatggtatcgaggttgggtgcgacgacggcccctggacgaagggcttggagtggatgggagtggatcgagcgtacttaacaagtcggtacaaccaactaaactactagacccaaccaacgaaccctcgaacggggctaaggactccgaaaccagtaccgaacccaacgaacgaccaaccactaacccacggaacgacccgtaacccggaccttaaacgacgtacggaacccgtagggaacggaccgtacctagggaacgtacttacggacggaaccgaccggacgggtacccgttaggtttaactacggtggtacggacgtagggtaaaggtacggttaaacgggtaaatttcggtttacgtacgtttaccggttaccttcgtttacggacgttaccgggtacggggtacccgtaacgggtaacccgtttccgg

SEQ ID NO: 392072 - DNA, 673 bp, Homo sapiens
  misc_feature: GZ8MTXP02G46SB.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacaccttacactatgtatcgagttggtgcgacgaggcccctggacaaggcttgagtggagtgggatggatcgaggccgtacttaacaaagttcggtacaacgaaacctaaaaccgtatacggacccaacgaacgtaaaccccgtccgaaggggaccaaggtacggtaccaaacctaacgtaccgaaacccaacgaacgaaaccctaaccaactacccgaaacggaacgaccgaacccggaccctaacgaacgtcgggtaacccaggaacggacgtacccgtagggaactagttaccgacggaaccgaaccgacggtaccggtagttactaacggtgtcggacgtaagaggtaggtaacgggtaaattgtttacgaccgttcgtacccttgttacgacgttacggcgggaaccgtacgggtaaccgtcgg

SEQ ID NO: 392073 - DNA, 552 bp, Homo sapiens
  misc_feature: GZ8MTXP02IZ7NY.39.81.H04.1.454.CMB.2.raw
  modified_base (215)..(215): a, c, t, g, unknown or other
  modified_base (364)..(364): a, c, t, g, unknown or other
  modified_base (378)..(378): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttaccaactatggtatcagttgggtgcgacaggcccctggacaagggcttgagtgatgggatggatcagcgcttacaatggtcacacaaactatgccacagaacctcaggcagngtcacatcgaccanagacacatccacgagcacgcctacatcggacctaggacggagccgtgacgtatcgtagacgaccgacggccgtgtacttacgtgtgcgagaggagtacgggggtaaattacgtttcgaacgttcggtaccttcgtttcgacgttacgtcggggtaccaacggggtacccttcgg

SEQ ID NO: 392074 - DNA, 660 bp, Homo sapiens
  misc_feature: GZ8MTXP02H25TA.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagcaaagcctcgtatacattgatggaaacacctacttgaattggttcagcagaggccaggccaatctaccgaaggcgacctaaatttagtaacggtttctaaaccgggactcgtaggggtcccaagacagacttcgagcggacaggtcggtcaggtccaacttgaaacttcgaactaacgtagaaaaactcgaagacgaggggtaggaaggtcgtaggagggtagttaggggtttaggggttttacttaacgtcggtaacgtagtacggtacgaaaacgggaaccgtaacgtaccgttacgggtaccccgtttaccgtaaaccgttacggtttttacggaacccggtaacgggggtaacccaaaggtccgtaggaaacgtacgtaaccgaaacgttaaccgtggttaacggactacgaccgtacgtacttcgtacggttcc

SEQ ID NO: 392075 - DNA, 646 bp, Homo sapiens
  misc_feature: GZ8MTXP02HNOZ8.39.81.H04.1.454.CMB.2.raw
  modified_base (250)..(250): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtgggatgttgtgatgactcagtctccagtcctccctgcccgtcacccttggacagccgcctccatctcctgcaggtctagtcaaagcctgtatacattgatggaaacnctatgaattggttcagcagagcaggccaatctaccaaggccactaaattttaataaggtttacgaaaccgggctcgtcggggtacccaaggtacagtacttcgacgccggtctagggtcggggtacaagggctaacgtagtaaacttcgaaactaacgtagaaaatcgaagacgagggtaggaggacgtaggaaggtagttggttaggggtttatttacgtagactagtagaacggaaagaaccgtaacgacgttacggacccgttaccgttaacgtaccggttttacgggacccggtaacgggggtaaccaaacgggtccgtaagggaacgtaaaccgtaacgtaaaaccgtaaccgtggtaacggtcggttacgaccgtaccgtaacgtttccg

SEQ ID NO: 392076 - DNA, 662 bp, Homo sapiens
  misc_feature: GZ8MTXP02I0CN7.39.81.H04.1.454.CMB.2.raw
  modified_base (380)..(380): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctcctgcaggtctagtcaaagcctacgtatacattgatagaaacactactagattggttcagcagacggccaggaccaatccacgaaggcgtacctaaatttagtaacggtttacgtaacccgggtatccgtcggggtacccagacagtacttcgagcgacaggtcgggtacngggactacgtagtaacttacgaacaacgttaagaaaaacgttcgaaacggacggagggggttacgggaggtacgtaggaaggtaggtttaggggtttagggggtttaatttaaccggtgtacgtaacttaggaaccgtaaacgggaacaaccgtacgtcggtacccgttacgtaccttacgtttaccggacggtaacggggaccgtaaaggccggttagggaacgtacgtaaaccgaaacgtaacgtcggtacgtacgtacggacctacctagttctttacg

SEQ ID NO: 392077 - DNA, 628 bp, Homo sapiens
  misc_feature: GZ8MTXP02FWPIS.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgcttacaatggtacaacaacaaactatgacccacacgaaccctccgagggccaagcgtcaccatacgaccacagaacacatcccacgagaccaccggccctaacagtcggacccgtaggacgggaacgcccgtagaacggattaccgtacggaacggaaccgaccgggtcccggttggttaactttaccgtggttacgacggtaacggagtaaggtacgggggtaaaattacggttttacgacgttacggttacccttcgtttacgacgttacggtcggggtaccgaacggggtacccgttacggg

SEQ ID NO: 392078 - DNA, 580 bp, Homo sapiens
  misc_feature: GZ8MTXP02JEENF.39.81.H04.1.454.CMB.2.raw
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgaggttgggtgcgacacggcccctggacaagggcttggagtggagtgggatggatcgagcgcttacgatggtacaacacaaactatgaccacagaacctccgaggccagcgtcacatacgaccanacgacacactacccaacgacgaccaccgacctacgagtcggacctggacgacgccgtaggacgtatacgacgaacgacgacggtcgtagtacttacgtgtcgacggagagtacggtaacgggtaaaattcgtttacgaccgttcgttacccttgtttacgaacgttcggcgggaccgacgggtacctcgg

SEQ ID NO: 392079 - DNA, 720 bp, Homo sapiens
  misc_feature: GZ8MTXP02G2TEQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacgacggcccctggacaagggcttgaggtggagtgggatggatcgagcgtacttaacaagttcggtacaacgaactaaaactatcgaaccacaacgaaccctacgagggccaagcgtaccaccatacgaaccacgaagaccaacactacccgaacgacgaccaaccggaccctaacgagtacgggaacctaggaacggacgacccgttaggaacgtacgtaccgtacgggaacccgtaaaccggaccgggtacccggttagtttaaacgttaacggttacggtacggaaccggtaagggtaaagggtaaacgggttaacgggggtaaaaatttacggttttacggaaacccgtttccggttaaaaccccgtttcgttttaacggaaccgtttaccggggtacgggggtaaccccgttaacgggggtaaacccctttccgggg

SEQ ID NO: 392080 - DNA, 595 bp, Homo sapiens
  misc_feature: GZ8MTXP02H2XTF.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatcctaccaggcgaccttaaatttataaaggtttctaaaccgggacttcgtacggggtcccagtacagtacttcgagcggacgagtggggtcagggcactgaattcacactagaaaatcagcgaggggtaggagcgtaggaggtatggtttaggggttattacgtgacagttgacaaagggaacacgacgtacggtacctccgttaacgtacgttttacggggacccgtaagggggaacccaaaggctagggaacgtaactaaccgaaaaaccgtaacgtgtacgggactacggaccaaccctatacctttcg

SEQ ID NO: 392081 - DNA, 630 bp, Homo sapiens
  misc_feature: GZ8MTXP02H5PHO.39.81.H04.1.454.CMB.2.raw
  modified_base (371)..(371): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttactacctttacaactatggtatcaggttgggtgcgacaggcccctggacaagggcttgagtggagtgggatggatcgagcgacttaacagtggtacaacaaacaaactatgacccacaacgaacccnccgagggacaggacgtaccaacactacgaaccaacgaacgacaacacaccgaacgacgccgaaccggcctaacgagtacggaccctaggaacgggactaccgtagaacgtacgtaccgtacgaaccggaacgaaccgggtcccgttagttaactttaaccgtggtacgaccggtaagaaggtacggtacgggtaaaatttcgttacgacgttcgtacccttgttacgacgtacggtcgggaccgacggtaacccgtcgg

SEQ ID NO: 392082 - DNA, 608 bp, Homo sapiens
  misc_feature: GZ8MTXP02HZK9G.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaaggcttgagtggatgggatggatcgagcgtattacaagtggtacacaacaaaactatcgaccacaacgaacctccgagggaccagacgtcaactatcgaaccacagaccacactcccaacgacgccgaaccgtcctaaccgagtacggaccgtaggacggacgccgtagacgtatcgtagaaccgaacgccgggtaccgttagtaacttcgagtcgacggacgagtaacggtacggggtaaatttacgtttacgacgttacggttaccccttgtttacggtacgtaccggtcggggtaccgtacgggtaaccctcgg

SEQ ID NO: 392083 - DNA, 741 bp, Homo sapiens
  misc_feature: GZ8MTXP02GD7IT.39.81.H04.1.454.CMB.2.raw
  modified_base (328)..(328): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacaactatggtatcaggttgggtgcgacaggcccctggacaagggcttggagtggatgggatggatcagcgtcttanaagtggtacaacaacaaactatcgaccaacgaacgaaaccctccgaggggaccaagggacgtaccaaaccctaagtaccgaaacccaaacgaacgaaacccaaaccaaaccgtaccccaaacggaacgacccgaaacccggggacccctaacgaacgttacgggaacccttagggaacgggaccgtacccgtaggaacggtacttcgacgggaaccgaaaccgtaccggggtacccgttagttaaacgttaccgtggtacggaccggtaagaacggtaaacgggttaccggggtaaaaagtttacgtttttacggaaacccgtttcggggttaaaccccctttcggttttaacggtaacccggttaacggtaccgggggtaacccctaacgggggtaacccccgtttacgggg

SEQ ID NO: 392084 - DNA, 588 bp, Homo sapiens
  misc_feature: GZ8MTXP02IF3E5.39.81.H04.1.454.CMB.2.raw
  modified_base (486)..(486): a, c, t, g, unknown or other
tcagtcgcactagtcacgaccggtgctcgatttagtagtgtagattcgcgggacccaaaaaccacaccctccttgggagaatccctagatcacagctcctcaccatggactggacctggagcatccttttcttggtggcagcaacaacaggtgcccacctcccaggtttttttcagctggtacagtctggagctgagatgacgaaggccgtggggcctcagtgaaggtctcctgcaaggcttctggttactaccttacctaactatggtatcagttgggtgcgacaggcccctggacaagggcttgagtggatgggagtggatcagcgcttacaatggtcacaacaaaactatgccacacgaacctccgaggacagagtccaacatacgaacccaacagaacacatcccaacgacgacacggacctacgaatcgggacctgacggacgcctagacgatctagaacgacgacggccgtagtattacngtgcgagagagtacggggtaaaatacgtttttagactttcgggttaacccttgtttacgtacttaacggtcgggggtcccgaagggggtaaccccgttcggg

SEQ ID NO: 392085 - DNA, 655 bp, Homo sapiens
  misc_feature: GZ8MTXP02I0KM1.39.81.H04.1.454.CMB.2.raw
  modified_base (275)..(275): a, c, t, g, unknown or other
  modified_base (370)..(370): a, c, t, g, unknown or other
  modified_base (383)..(383): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaagtggtacacaacaaactatgaccacacgaacctcgaggcagngtcacatgaccanagacacatacccaacgagacgaaccggacctaacgagttacgggaacccttaggaacgggaacgcccgttaggacgtaacgtccgtaggaaacccgacccgaaccggggtcccgttaggtaacgtttaaccgtaggttggaccgggtaaacggaacggtaaggttaaccgggggtaaaaatttcggttttaagaccgttcgggttaaacccttcgtttacggtaaccgttacggtacgggggaccgtaacgggggtaaacccccgttcgggg

SEQ ID NO: 392086 - DNA, 686 bp, Homo sapiens
  misc_feature: GZ8MTXP02FPBII.39.81.H04.1.454.CMB.2.raw
  modified_base (353)..(353): a, c, t, g, unknown or other
tcagtcgcactagtcacgaccggtgctcgatttagtagtgtagattcgcggggacccaaaaaccacacccctccttgagagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacgggcccctggacaagggtcttggagtggatggggatggatcgagcgcttaacaatggtacaacacaaaactntcgacacagaaccctccgaggggcaggacgtaccaaccatacgaaccacaacgaaccacactacccgaacgacgaccgtaccggaccctaacgaacgttcgggaacccgtaggaacgggaacgccgtaggaacggtaactccgtaacggaaccgaaccggaaccggggtcccgtttaggtaacgtttaacgtggttacggtacggaaggaacggtaaggttaaaccgggggtaaaactttacggtttttacggaaccgtttacggttaaccccgtttacgtttacggtaaaccgttacggttacgggggaacccgtaacgggggtaaaccccg

SEQ ID NO: 392087 - DNA, 619 bp, Homo sapiens
  misc_feature: GZ8MTXP02GJ4JP.39.81.H04.1.454.CMB.2.raw
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaggcttggagtggatgggatggatcagcgcttacaatggtcacacaaactatgccacagaacctccagggcagngtacacatgaccacagacacatacccaacgacgaccaccggaccctaacgacgtacgggaaccttacggaacgggacgcccttaggacggaacgtcgtacggaccggaaccgaccgggcccgttaggttaacttacgttcgtggacggaagtaggacgtacgggggtaaaattagttttacgaccgttacggttaaccccttcgtttacgtaaccgttacgtcgggggtaccgaacggggtacccgtttacggg

SEQ ID NO: 392088 - DNA, 628 bp, Homo sapiens
  misc_feature: GZ8MTXP02IVFXN.39.81.H04.1.454.CMB.2.raw
  modified_base (417)..(417): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttacaactatggtatcagttggtgcgacacggcccctggacaagggcttggagtggatgggatggatcgagcgactttaacgaagtggtacaaacgaacaaaactatacgacacaacgaaccctcgaaggggcaggacgtacaccatacgaccaacacgacacacnccaacgacgccacggcctaacgacgtcggacctaggacggacgccgtaggagtacttacgacgaaccgtacgacgggtccgtagttacgttacgtgtacgacgaggaggaacggtaacggggtaaactttagttttacggacgttacggttaaccccttgttttacggaaccgttacggtaccggggtacccgtaacggggttaacccccg

SEQ ID NO: 392089 - DNA, 652 bp, Homo sapiens
  misc_feature: GZ8MTXP02F6BDV.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttggtgcgacacggcccctggacaagggcttgagtggatgggatggatcgagcgtacttaacaagtggtacaacaacaaaactatcgacccaacgacgaaaccctcgagggccaagcgtccaacatacgacccaacaacgaccaacactacccgaacgacgaccgtaaccggaccctacgaacgttacgggaaccctaggacggaacgtcccgtaggaacggtactcgtaacggaccgtaaccgacgggtaccgttagtaacttcgtggtcgacggtaagacggtaacggttaacggggtaaaatttaggtttacgaccgttacggttacccttgtttacggaacttacggtcggggacccgtaaccggggtaaccttccggg

SEQ ID NO: 392090 - DNA, 610 bp, Homo sapiens
  misc_feature: GZ8MTXP02JC0I0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcaggttgggtgcgacacggcccctaggacaagggtcttggaggtggagtgggatggatcgagcgtacttaacaagtggtacaacaacaaactatgacccaacacgaaccctcgagggccagcgtaccaacatacgaccagacgactacatcccgacgagccgaccgtactacagtacgacctaggaggacgccgtagacgtactcgtagggaaccaacgaccgggccgttaggttaaactttcgtaggtgacggaagaggtaaggtacggggtaaaatttcgtttacgaccgttcggtaacccttgtttagacgttacggcggggtacctacggggtaccttcgg

SEQ ID NO: 392091 - DNA, 569 bp, Homo sapiens
  misc_feature: GZ8MTXP02HD1RD.39.81.H04.1.454.CMB.2.raw
  modified_base (259)..(259): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactntggtatcagttggtgcgacaggcccctggacaaggcttgagtggatgggatggatcagcgcttacaatggtcaacacaaactatcgcacagaaacctcgagggcagacgtcaccgatcgaccacacgacacactaccaacgagaccacggaccctacaagtcggaccgtgaacggacgcctaggagatacgtacgacgacgacggccgtagtattactggtcgacggagagacgtaggggaaacttagttttacgacgttcggtaaccttcgtttacgacgtacgtcggggaccgtaacgggtaacccgg

SEQ ID NO: 392092 - DNA, 655 bp, Homo sapiens
  misc_feature: GZ8MTXP02GSO5K.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttgagtggatgggatggatcgagcgcttaacaagtggtacacaaacgtaaaactatcgacccaacaacgaacctccgaaggggccaaggacgtccaaaccgtagtacgaacccaagaaacgaacctaacaactacccgaaacgacgaccgaacccggtaccctaacgaacgtcggaaccctggaacggacgcccgttaggaacgtacttccggaacggaaccgaaccgaccgggccgttaggtaattaccgtgtacgacgaagacgtaaggtaacggggtaaatttacgtttacgacgttccggttaaccccttgtttacgaacgttacgtacggggacccgaacgggtaaccctcggg

SEQ ID NO: 392093 - DNA, 640 bp, Homo sapiens
  misc_feature: GZ8MTXP02G7B7J.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatggaaacacctattgaattggttcagcagagccaggccaatctaccgaaggccgtaccttaaatttagtaacggtttcaaccgggtactcgtcggggtacccagacagactcagcggctaggtgggtcagggcaactagaacttcaacaactagaaaactcgaagcgaggggtaggaggtcgtagggaggtaagtttgggtttaggggtttaattacgtggtacgtagtcggaacgaaagggaaacctaccgaccgttacgggtacccttacccgtaacgttacggttttcgggacccggtaaacggggaccctaaaggcgttacggaacgtaacgttaaccgaaaacgtaacgtaaggttacgggactacggtaaccgtacctacgttacgtttacg

SEQ ID NO: 392094 - DNA, 631 bp, Homo sapiens
  misc_feature: GZ8MTXP02F25VP.39.81.H04.1.454.CMB.2.raw
  modified_base (348)..(348): a, c, t, g, unknown or other
  modified_base (373)..(373): a, c, t, g, unknown or other
  modified_base (388)..(388): a, c, t, g, unknown or other
  modified_base (404)..(404): a, c, t, g, unknown or other
  modified_base (487)..(487): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggcccctggacaagggcttggagtggatgggatggatcgagcgcttacaatggtacacaacaaactntgaccacacgaacctcgagggcagngtccacatcgaccanagacacatcccagacncacgacctacagtacggacctagacggacgcctaggacgtatccgtaggaccgaaccgacggtccgttagttaactttaccgnggttcgacggaaggtacggtaaaggttaccgggggtaaaaattttcggttttacgaaccggtttccgggttaacccctttcgttttaacggaaccgtttaccggggcggggtacccgtaacgggggtaaacccctttccggggg

SEQ ID NO: 392095 - DNA, 659 bp, Homo sapiens
  misc_feature: GZ8MTXP02H9FLU.39.81.H04.1.454.CMB.2.raw
  modified_base (272)..(272): a, c, t, g, unknown or other
  modified_base (276)..(276): a, c, t, g, unknown or other
  modified_base (349)..(349): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacactatgtatcagttggncganacggcccctggacgaaggtcttgagtggagtggggatggatcgagcgtacttacaagtggtcaacacaaactntcgacaacagaaccctcgagggcagacgtacaaccgatacgaacccaacacgaaccaacactaccgacgacgaccgacggtacctacagtcggacctggaaacgggcgtaccgtaggaagtacttaccgtacggaaacccgacgaacccgggtcgttaacggttactttaaccgtggttacggaacggtaggtaaacggtacggtttaaacgggggtaaaatttcgtttacggaaccgtttacggttaacccgtttcgtttacggtaaccgttaggtacccgggggtaccgtaaaccggggttaaccccg

SEQ ID NO: 392096 - DNA, 591 bp, Homo sapiens
  misc_feature: GZ8MTXP02JMGE5.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagcctcgtatacattgataggaaacacctactgaattggttcagcagagccaggccaatctccaaggcacctaatttagtaaggttctaaccgggactcgtcggggtcccagacagatcagcgcgaggtgggcagggcacgtagaacttcaacactagaaaatcagacgaggggtggaggcgtaggaggtagtgggtttagggttattacgtgactagtagacgtaacggaacacgtaaccgtcggtacccgtaccgttacgttacggtttacggacccggtaacggggacccgaaaggtccgtagggaacgacgtaacgaaaacgtacgtaaggtacggacgtacgaccgacctacgtactttcg

SEQ ID NO: 392097 - DNA, 731 bp, Homo sapiens
  misc_feature: GZ8MTXP02HWUZS.39.81.H04.1.454.CMB.2.raw
  modified_base (362)..(362): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctgttacacctttacaactatggtatcagttgggtgcgacacggcccctggacgaaggcttgagtggagtgggatggatcgagcgtacgtttaacaagttcgggtacaacgaaacaaaaccttntacgacccaacaaccgtaaccctaccgaaggggaccaggacgtccaaccagtaccgaaccaacgagaacccactaactcccgaacgacgaccgacccggtacctaacgagtaccgggaccctaggaacgggacgtacccgtaggtacggtacttaccgtacggaacccggaaccgaacccggggtcccgttaggttaacgtttaacgtcgggttacgaaccgggtaacggaaaggtagggtaaacccgggggttaaaattttacggttttacgaaccgtttcgggtttaacccccttaaggtttttacgaacccggtttacggtaccgggggtaacccgtaaccgggggttaaaccccgtttaccgggg

SEQ ID NO: 392098 - DNA, 629 bp, Homo sapiens
  misc_feature: GZ8MTXP02HJGVC.39.81.H04.1.454.CMB.2.raw
  modified_base (426)..(426): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttacaactatggtatcgaggttgggtgcgacgacggcccctggacaagggtcttaggaggtggagtgggatggatcgagcgtacttaacaaagtggtacaacgaaactaaaactagtcgacccaacaacgtaaccctcgaagggcaagacgtacaaccataccgaaccaacgaanaaccaacacacccaacgacgaccaaccggacctaacacgtacggaacccgtaggaacggaacgcccaggacgtactcgtacgaacgacgaccggtccgtagtacttacgtgtacggacgaaggaggtagtaacgggtaaattacgtttacgacgttacgtacccttgttacgacgtacggtcgggaccgaacgggtacctcgg

SEQ ID NO: 392099 - DNA, 690 bp, Homo sapiens
  misc_feature: GZ8MTXP02IRWCA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttcgtggttactacctttacaactatggtatcgagttgggtgcgacgacggcccctggacgaagggtctggagtggagtgggatggatcgaggccgtacttaacgaaagttcggtacaaacgaaacaaaactatcgacccaacaacgtaaccctaccgaggggaccaagcgtaccaaacgataccgaaccaacgagtaaaccaacgacacccgaacgaacgaccaacggtccctaacgaacgtacggaacccgtgggaacgaacggcccgtaaggaacgtatacccgtacgggaaccgaacccgacggtaccgttggttaaacgttcgtaggtacgaacggacgaaggtaacggttacggggtaaaatttacgttttcggaaacttccgggtttaaccttcgtttacggaaccgtttacgggtacggggaccgtaaccggggtaaccctcggg

SEQ ID NO: 392100 - DNA, 590 bp, Homo sapiens
  misc_feature: GZ8MTXP02JVR9A.39.81.H04.1.454.CMB.2.raw
  modified_base (214)..(214): a, c, t, g, unknown or other
  modified_base (341)..(341): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttacaactatggtatcagttgggtgcgacaggcccctggacaagggcttgagtggatgggatggatcagcgcttacatggtcacacaaactntgaccacagaacctccgaggcagcgtacacatgaccacagacacataccacgacgcacggactaccgagtcggaccctggaacggagccgtaggacgagtacgtacgaacgaaccgaccgggaccgttagtaaacttcgtacggtgacggaagtacggtaagtacggggtaaaattagtttacgaacgttccgggtaaccttcgtttacggacctacggtcgggaccgtaacggggtaaccccttcggg

SEQ ID NO: 392101 - DNA, 677 bp, Homo sapiens
  misc_feature: GZ8MTXP02IJOSZ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctacctttacaactatggtatctagttgggtgcgacacggcccctggacgaagggcttagagtggagtgggatggatcgagcgtacttacgaagtcggtacaactaacaaactagtacgacccgtaaacacgaaaccctccgaacggggacaacggtacgtaccaacccagtacccgaacccaacgaacgaaccaacgactacccgaacgacgaccgaacccgtacctaaacgacgtacggacccgtaggacggaacgccgtaagacggtactacgtacggaccgaccggacggtaccgttagtacgttacgtgggtacgacggtaaggacggtaaggtacggggttaaaatttacggtttacgtaaccgttacggttaccttaagttacggacgttacggtacggggacccgtacgggtaacccgtcgg

SEQ ID NO: 392102 - DNA, 620 bp, Homo sapiens
  misc_feature: GZ8MTXP02HIP04.39.81.H04.1.454.CMB.2.raw
  modified_base (276)..(276): a, c, t, g, unknown or other
  modified_base (350)..(350): a, c, t, g, unknown or other
  modified_base (383)..(383): a, c, t, g, unknown or other
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctggttacacctttacaactatggtatcgagttgggncgacacggcccctggacaaggcttgagtggatgggatggatcgagcgtacttacaatggtacaacaacaaactntgaccacacgaccctcgagggcagcgtacacancgaccanacgacacacaccacgacgactaccgacctacgacgtacggacctaggacgtacgccgtaggacgtaacgtcgtacggaaaccgaccgaaccgggtccgttaggttaacttacgtggtacggaacgaaggtacggtaaggtaaaccgggggtaaatttagtttacgtaccgttacggtacccttgtttacgacgttacgggtcgggacccgtaacgggtaaccccgtcggg

SEQ ID NO: 392103 - DNA, 637 bp, Homo sapiens
  misc_feature: GZ8MTXP02JVXWB.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccgttggacacgccggcctccatcctctgcaggtctagtacaaagcctcgtatacattgatggaaacctactacttagattggttacagcagaggccaggccatcacgaacgctaccttaatttagtaacggttacgaaccgggtacttcggtcggggtaccagactagacttcgaggcggacgagggtggtcgagggtctaacgtagtaacttcaactactagaaaacttcgaaggtacggagggggtaggagggtacgtaggggtaggtaggtttaggggtttaggggtttaacttacggtgacgtagtcgaacggaaacgggaacaccgtaacgtcgggtacccttacggtaacgttacgtttcgggaccggtaacggggaccaggcggtaacggacgaactacggaaacgaacgttggacgtctacggaccctaacgtgtcgtttacg

SEQ ID NO: 392104 - DNA, 579 bp, Homo sapiens
  misc_feature: GZ8MTXP02HGNEG.39.81.H04.1.454.CMB.2.raw
  modified_base (347)..(347): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcagcgcttacaagttggcaacacaaaactntagaccacgacgaaaccctcgagggcagacgtcaaccatacgaaccagaacgaccacatcccgagacgcacggcctacagtcggactgaggacgccgtaggacgtatcgtacggaacgaccgacgggtaccgtagtacttacgtggtagccggtaagacggtagtacggggtaaaattgtttacgacgtcgttacctgttacgacgtcggtcgggaccgacgggtacctcgg

SEQ ID NO: 392105 - DNA, 692 bp, Homo sapiens
  misc_feature: GZ8MTXP02JYW8S.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggngcgacaggcccctggacaagggctggagtggatgggatggatcgaggcgcttaacaagtggtaccaacaacctaaaactagtcgacccaacgacgtaaaccctccgaaggggaccaaggacgtaccaaaccaagtaccgaacccaacgaacggaaacccaaccgactacccgaccgaacgcccgaaccgggtccctaaacgacgtacgggtaaccccgttgggaacgggtaccgtcccgttaggacgtaacgtaccgtacggaaaccggaccgaaccggggtcccgtaggtttaacgttacgtaggtcggtacggaaggtacggtaggtaaccggggtaaatttacgtttacgaccgttacggttaacctcgtttacgacgttacggtcggggtaacccgacgggtaacccgttcggg

SEQ ID NO: 392106 - DNA, 638 bp, Homo sapiens
  misc_feature: GZ8MTXP02I1J1U.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacgaagggcttggagtggagtgggatggatcgagcgcttacaagtcggtacaacaacaaactatcgaccacacgaaccctccgaggacaagcgtacaaccaagtcaaccacgaacgaacccaacaactacccgaacgaacgcccgaaccggaccctacaagtcggaaccgtggaacggaacgcccgtagaacgtacttcgacgaaccggaccaccgggtccgtagtaacttacgtgtacgacggaagtacggaagttaacgggggtaaaattagtttacgacgttaccggttacccttcgtttacgaaccgttacggtcggggtaccgtaacggggtaacccttacgg

SEQ ID NO: 392107 - DNA, 711 bp, Homo sapiens
  misc_feature: GZ8MTXP02H7RED.39.81.H04.1.454.CMB.2.raw
  modified_base (351)..(351): a, c, t, g, unknown or other
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaaacctggggcctcagtgaaggtctcctgcaaggcttctggttacacctttacaactatggtatcgagttggtgcgacacggcccctggacaaggcttgagtggatgggatggatcgagcgtcttaacaagtgggtacaacgaacaaaactntagacacccaagaaccctccgaggggacaggacgtcaaccgatcgaaccacagacacactaccgaacgacgacaaccggaccttaacgacgtacggaccctaggacggacgtaccgagacgtacgttacgtaggaaaccgacgaacccggggtacccgttaggtttaaccgtttaaacggttccgggttaggtaaccggggtaaaaggaagggtaaacgggtttaaaccggggggtaaaatttaacggtttttacggtaacccgttaccggggttttaacccccttaggttttaacggtaaacccgttaaccggtacgggggaccctaaaccgggggtaacccgttcggggtaacccccg

SEQ ID NO: 392108 - DNA, 594 bp, Homo sapiens
  misc_feature: GZ8MTXP02HFQ9M.39.81.H04.1.454.CMB.2.raw
  modified_base (352)..(352): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtacaaagcctgtatacattgatagaaacacctattgaattggttacagcagagccaggcaatctccaaggccacttaatttagtaagtttcctaaccggactcgtcggggtccagacacgattcagcggntaggtgggtcgaggctacgtagtaattcaactactaagaaaatacgagacggaagggggtggaggacgtaggagggtagttgggtttaggggttttaatacgtgctaagtgacgaaacggtacaacgacgtcgtacctaccgttactacgtttcggacgtaacggggacctaacggcgtaggacgtaacgtaaccgaaaacggtaacgttcgacggtacgtacgtaccgaacctacgttccg

SEQ ID NO: 392109 - DNA, 613 bp, Homo sapiens
  misc_feature: GZ8MTXP02IUP9W.39.81.H04.1.454.CMB.2.raw
  modified_base (370)..(370): a, c, t, g, unknown or other
  modified_base (383)..(383): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctcctgcaggtctagtcaaagcctcgtatacattgataggaaacctacctacttagaattggttcagacagacggccaggccaatctaccgaaggcgtaccttaaatttagtaaggttcctaaccgggacttcgtacggggtacccagacgagtactcgagcgngtaggtgggtacngggcacgtgtaacttacacactaagaaaatcgaagacgtaggggtggaaggcgtaggaggtagtttggggttaggggtttaattacgtgtactagttagaacgaaaggaacacgtacgtcggacctaccgttactacgtttacggaccggtacgggaccgtaaggtcgtaggaactacgtaaccgaaaccggaagtcggtacgtacgtacgaccgtactacgttcttacg

SEQ ID NO: 392110 - DNA, 545 bp, Homo sapiens
  misc_feature: GZ8MTXP02IPBJ6.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctacttgaattggtttcagcagaggccaggccaatctccaaggcgcctaatttataggtttcaaccgggactctggggtcccagacagattccagcgcagtggtcaggcactgaattcacactagaaaatcagcgagggtggaggctagagggtattgggtttagggttattcgtgactatgacaaggtacacacgtgaccctcgtactacgtttcggaccgaggggaccaagctagggaacgaacgtacgaaaacggtactaggtaacggctacgaccactacttcgtacgttcc

SEQ ID NO: 392111 - DNA, 573 bp, Homo sapiens
  misc_feature: GZ8MTXP02HK8CR.39.81.H04.1.454.CMB.2.raw
  modified_base (358)..(358): a, c, t, g, unknown or other
  modified_base (367)..(367): a, c, t, g, unknown or other
  modified_base (383)..(383): a, c, t, g, unknown or other
  modified_base (391)..(391): a, c, t, g, unknown or other
  modified_base (408)..(408): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctcagtctccctgcccgtcacccttggacagccggcctccatctctgcaggtctagtacaaagtcctacgtatactattgaatacggaaactacctacttagtaattggttcagcagacgccgacgcaatccacgaagcgtactaatttagtaacggtttacgaacggactcgtcgggaccagacagtatcgagcgnaggtgtacngcactagattcactanaagaaacncagacgagggtaggagngtaggaggtagttggttagggtttatagtgacagtgaacgaaggaacacgacgtacgccgtaccgtacgttacgtttacggacgtaacggacgacggtagtaaggacggtaactaacgaaacgtaacgtggtaacggctacgaccaacttactaccgttcttccg

SEQ ID NO: 392112 - DNA, 639 bp, Homo sapiens
  misc_feature: GZ8MTXP02IP99J.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacacgccgcctcatctcctgcagtctagtcaagcctgtatacattgatagaaactacctattgaattggttcagcaggagccaggccaatctaccgaaggccgtaccttaatttagtaacggtttacgtaaccgggactcgtggggtccccagtacagtattcaggtcggcgtaggtgggtcgaggcctacgtagaacttacaacgactaagaaaatcgagcgtaggggtggacggtgtaggaggtagttaggggtttaggggttttaataacgtgacgtagtcggacgaaaacggtaacaccgtaacgttcgtcccgttaccgttaacgtacgttttaccgggaccggtacgggggaaaccctaaagggtccgtaaggggactaaaccgtaaccgtaaaacggtaaccgttggtaacggtcgtacgaccgtaaccgtagtttccg

SEQ ID NO: 392113 - DNA, 718 bp, Homo sapiens
  misc_feature: GZ8MTXP02F3336.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgtagttggggtgcgacaggcccctggacaagggcttgagtggagtgggatggatcagcgtcttacaatggtacacaaacaaaactatcgaccacaacgaaaccctccaaggggaccaaggacgtccaaccctaataccgaacccaaacaagaaccaaacaactacccaaacgacgaccaacccggtaccctaaccgaagtacgggaaccctagggaacggacggcccgtaggaacggattaccgtacgggaaccgaaccgaccggggtacccgttacggttaaattaaccgtggttacgggaccggtaaacggaacggtaaacgggttaacgggggtaaaaacttttaggtttttaccggtaaaccggttaccggtttaaacccccgtttgtttacggtaaccgttaccgggttacgggggtaccccgaaccggggtaaccccgttaccggg

SEQ ID NO: 392114 - DNA, 657 bp, Homo sapiens
  misc_feature: GZ8MTXP02G0LD0.39.81.H04.1.454.CMB.2.raw
  modified_base (554)..(554): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacaaggcttgagtggatgggatggatcgagcgcttacaagtggtacaacaacaaaactagtcgaccaacaacgaaaccctccgaaggggaccaagggcgtaccaaaccagtaccgaacccaacgaacgaaccaaccaacgtacccgaacgaacgacccaaccgggtaccctaaccgagtacggaacccttagggaacgggaacgcccgtaggaacggtaatcgtacgggaaccgaaccgaccgggtccgttagttaacgttacgnggtacgacggagaacggtacggtaacggggtaaaattagtttacgacgttcggttaccctgtttacgaccgttacggacgggtaccaacggggtaacctcggg

SEQ ID NO: 392115 - DNA, 695 bp, Homo sapiens
  misc_feature: GZ8MTXP02FNJHS.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttggtncgacacggccctggacaaggcttgagtggagtgggatggatcgagcgcttaacaagtggtacaacaacaaactatgaccaacacgaacctcgaggacagcgtcaacatcgaaccacagaacacactacccgaacgacgaccgaacccggaccctaacgaacgttacgggaacccgtagggaacgggacgcccgttaggaacggtacttaccgacggaaccgaaccgaacgggtcccggttagttaacgtttacgtgggtacgacggtaacggaaggtaacgggttaacgggggttaaaatttacggtttttacggtaaacccgtttacggggtttaaccccctttggtttttaacggtaaccgtttaccggggtaccgggggtaccccgtaaacggggggtaaccccgtttacccggggg

SEQ ID NO: 392116 - DNA, 543 bp, Homo sapiens
  misc_feature: GZ8MTXP02IPUU6.39.81.H04.1.454.CMB.2.raw
  modified_base (306)..(306): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacaggccgcctccatctcctgcaggtctagtcaaagcctgtatacattgatggaaacacctacttgaattggttcagcagaggccaggccaatctccaggcgacctaatttanaaggcttactaaccgggactcgtcggggtcccagaccagattcagcggcaggtggggtcagggcactgaattcacactagaaatcagcgagggtgaggctgagagtggtttaggggtttattacgtgtctagtgacaaaggacacacgtcgcctaccgtactacgtttcggaccgtacggggacctaaaggcgtagggaacgtagtacaaaacgtaactggtacgctagccactacg

SEQ ID NO: 392117 - DNA, 630 bp, Homo sapiens
  misc_feature: GZ8MTXP02FQFUB.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatagaaacacctacttgaattggttcagcagaggccaggccaatctaccgaaggcgtaccttaaattttagtaaacggtttaccgtaaaccggggacttccgtcggggtacccaagacagtattcgagcggacaggtgggtcaggcactagtaacttcaacactagaaaatcgaagcgagggtggaggcgtaggaggtagttagggtttagggtttaattacgtgtacgtagtaggaacgaaacggaaacacgtacgtacggtcccttaccggttacgttacgtttacgggaacccggtaacggggaacccgtaaaggtccggtagggaaacgtaacgtaaccgaaaacgtaacggtggtacgaccgttagacctaacgtactttacg

SEQ ID NO: 392118 - DNA, 637 bp, Homo sapiens
  misc_feature: GZ8MTXP02I4I4Q.39.81.H04.1.454.CMB.2.raw
  modified_base (332)..(332): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttctggttacacctttacaactatggtatcgaggttggtgcgacgacggcccctgggaccaaggggcttggagtggatggggatggatcgagcgntttaacgaatcggtacaacgacaaactatcgacaacacgaacctcgaggacaggacgtccaaccagtacgaaccaacacgaccaacactacccaacgacgaccgacggcctaacgacgtcgaaccgtggaagggacgccgagtaagacgttacgacggaaccgaccgaccggtcccgttagtaacgtttaccgtggttacggaccggtaaaggaacgggtaacggtacgggggtaaaatttacgtttacgaaccgttcgttaaccgtcgtttacgacgtacgtcgggaccgtaacgggtaccccg

SEQ ID NO: 392119 - DNA, 665 bp, Homo sapiens
  misc_feature: GZ8MTXP02GKW75.39.81.H04.1.454.CMB.2.raw
  modified_base (360)..(360): a, c, t, g, unknown or other
  modified_base (404)..(404): a, c, t, g, unknown or other
  modified_base (523)..(523): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactaccttaccaactatggtactcaggttggtgcgacgacggcccctggacaagggcttaggagtggagtgggatggatcgagcgtacttacaagtggtacaacgaactaaactntcgacacacgtaacctcgacggcaggacgtcacatacgaccaanacgtacacgactcccgagacgaccgacggacctaagacgtacggacctaggaacgggtacaccgtaggaatacgtccgtaacgaacccgtacggaccggttacgtagttagtttaccgngttacggacgtaggtacggtaacgggttaaccggggttaaatttacggtttaacggaccgttttaccggggttaacccctttacggtttaacgtaccggttaccggggtacggggtaacccggtaacgggtttaacccccgg

SEQ ID NO: 392120 - DNA, 624 bp, Homo sapiens
  misc_feature: GZ8MTXP02HTVOW.39.81.H04.1.454.CMB.2.raw
  modified_base (269)..(269): a, c, t, g, unknown or other
  modified_base (278)..(278): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcaggtctagtcaaagcctgtatacattgatggaaacactatgaattgttcagcagngcagcatcncagcactaatttataagttcaacgggtactcgtgggaccagacagtactcaggcggctaggtcgggtcagggctacgtagtaacttacaacgtaacgtagaaaacttcgaaggacgaagggggtacggaagggtcgtagggaagggtagtttagggtttagggggtttaattacgttcggactaaggttaggacgaaacgggaactaccgtacgtacgggtaccctaccggtaccttacgtttacgggacccggtaacggggaaaccgttaaggaccgtagggaacacgtaaaccgtaacggtaaacgtgtacggacgtacggacctaccgtacgtttacgttccg

SEQ ID NO: 392121 - DNA, 621 bp, Homo sapiens
  misc_feature: GZ8MTXP02GDVOO.39.81.H04.1.454.CMB.2.raw
  modified_base (272)..(272): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatgtatcagtggtncgacacggcccctaggacgaagggtcttggagtggagtggggatggatcgagcgactttaacgagtcggtacaacgaacaaaactatcgacacacgaaacctcgaaggcaggacgtcaaccatacgaaccaacgacgaactacacgtaccaacgacgaccgaccggcctaacacgtacggaccctaggaacggacgccgtagaagtacgtacgtacgaaccgacgaccggtccgtagtacttacgtgtcggacgaggagtacgtaggggtaaatttacgtttacgtacgttacgttaacccgttcgtttacgtaccgttacgtacggggaccgtaacgggtaaccccgg

SEQ ID NO: 392122 - DNA, 678 bp, Homo sapiens
  misc_feature: GZ8MTXP02FPTLF.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacaacaaactatgaccacacgaaccctccgaagggccaagcgtaccaaccatacgaacccacaagaaccaacatacccaacggaacgccaacccgggtaccctaacgaagtacgggaccctagggaacggacgccctagggaacgtagtccgtaggaaccgaccgaaccgggtccgttaggtaactttacgtggtacggacggaaggtaacggtaaaggttaccgggggtaaaaatttacggttttacggtaaaccgtttcggggtttaaacccccttgtttttacggaacccgtttaacgggtcgggggtaacccgtaacgggggtaaaccccgtttcgggg

SEQ ID NO: 392123 - DNA, 602 bp, Homo sapiens
  misc_feature: GZ8MTXP02HKRYF.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacacctacttgaattggttcagcagagccaggcaatcacaggcactaattataacggttcaacggactcgtgggtcccagacagatccgagcgcaggtggcagggcacgtagaattcaacactagaaaatcagcgagggtggaggcgtaggaggtagttgggtttaggggtttattacgttaggactaagtacgaacgaaaacgggaaacctaacgacgtacggtacccttaccggtaactaacggttttcggaccgtaacggggtaaccaaaggtccgtaacgggagtaaacgtaacgaaaacggtaacgtcggtaacggacgttacgacctaacgtacgttccttacgtttcc

SEQ ID NO: 392124 - DNA, 646 bp, Homo sapiens
  misc_feature: GZ8MTXP02F1406.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaagggcttgagtggatgggatggatcagcgcttaacaagtggtacacaacaaactatcgaccaacacgaaaccctcgagggccaaggacgtaccaaaccagtacgaacccaagaacgaccaacactacccaacgacgaccaaccggaccctaacgagtcggacctaggacggacgcctaggacgtatccgtacgggaaccgaaccgaccggggtaccgttagttaacgtttacgtggtacggacggaaacgaacggtaaacctaaaaccgtttccccgtaacctttaaccaaacgttacgttaaacgaacgtaagtaggggtaaacgttgtaccttttaatttccgtttacggg

SEQ ID NO: 392125 - DNA, 732 bp, Homo sapiens
  misc_feature: GZ8MTXP02I9IK0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttaccaactatggtatcgagttgggtgcgacacggcccctggacgaagggcttggagtggagtgggatggatcagcgcttaacaagtggtacaacaacaaactatcgccaacaacgaaccctcgaggacagcgtcaaccatacgaaccacgagaacacactacccaacggacgaccgaccggtacctaacctagtcgggtaacccgagggaacgggaacggacccgttaggaacggtattaccggtaggaacccggaaccgtaccggggtcccggtttagttaacgtttacggtagtacgggaccggaaaggtacggtaaacgggttaccgggggttaaaaattttacggtttttaccgggtaaaccggtttaccgggtttaacccccgtttaacggttttaccggtaaccgggtttaacccgggttccgggggtaaaccccggtaacccggggggtttaaaccccgttttaacccggggg

SEQ ID NO: 392126 - DNA, 651 bp, Homo sapiens
  misc_feature: GZ8MTXP02I5YW7.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctaggttggtgcgacacggcccctggacagggcttggagtggatgggatggatcgagccgtcttaacaagtggtaccaaccaacaaactatagacccacacgaaccctccgaagggacagacgtccaacatacgaaccaacgaacgaccacactcccgaacgacgaccaccggacctaacgacgtacgggaccctaggaacggacgaccgtaggacgtacgtccgtaacggaccgacgaccggtaccgttagttacgttacgtggtacggacgaaggtacggtaaggttaacgggggtaaaatttacggtttacgaaccgttccggttaacccttcgtttacgaccgtttaccggacgggggtaccgtaacggggtaacccgtcgg

SEQ ID NO: 392127 - DNA, 599 bp, Homo sapiens
  misc_feature: GZ8MTXP02IMG8Z.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagaggccaggccaatctcaaggcgaccttaatttataaggtttcaaccgggtactcgtggggtcccagacagacttcagcgcagtgggtcagggcatgaattcaacactagaaaatcagcgagggtaggaggcgtaggaggtagttgggtttaggggtttattacgtggactagtagacgaaagggaacaacgacgtcggtaccttaccggttactacgttttcgggaccgtaacggggaccgaacggcgtaaggaacggtaacgtaaccgaaaaacgtaacgttaggtaacggtacgtacggaccaaccgtacttcgttacgtttaccc

SEQ ID NO: 392128 - DNA, 744 bp, Homo sapiens
  misc_feature: GZ8MTXP02HARI5.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatcctcctgcaggtctagtcaaagcctacgtatacattgataggaaactacctattgaattggttcagcagacggccaggccaatcctaccgaaaggccgtaccttaaaattttagtaaacgggttttaccgtaaacccggggtacttccggtcggggtaccccaggtaacctagaccttaccgaaggccggtaccgtagggtcggggttccacgggggtcctaaccgttaggtaaactttacccgaaaccgtaaaccgttaaaggtaaaaaactccgaaagggaccgtaaggggggttaggaacgggggtacgttagggaaggggttaagtttaggggtttagggggttttaacttaaccggtggtaccgtaaggttacggaacgaaacgggtaaaccgtaccgtaccggttaccggtaccccttacggttacgttaccggtttacgggacccggtaaacggggtacccaaaggtccgtagggaactacgtaaaccgaacgtaacgtggtcgtaccgtacgaccgtactacgtcttacg

SEQ ID NO: 392129 - DNA, 598 bp, Homo sapiens
  misc_feature: GZ8MTXP02GNWR1.39.81.H04.1.454.CMB.2.raw
  modified_base (247)..(247): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccgcctccatctcctgcaggtctagtcaaagcctgtatacattgatgaaacnctattgaattggttcagcagaggccaggccaatctaccaaggcctacttaagtttataaggtttctaaccgggacttcgtcggggtacccagactagtactccagcgcaggtcggcaggcacgtagacttcacacgtagaaaactcgagacgtagggtggacggtcgtaggaggtagttagggtttaggggtttaactacgtggactagtaggacgaaagggactacgacgtacggtcctacgtacttacgtttcggaccgtacggggacctaaggcgtacgggactaacgtaaccgaaaacggtaactggtaacggtacgtacggacctaccagttccgtcggtttaccc

SEQ ID NO: 392130 - DNA, 693 bp, Homo sapiens
  misc_feature: GZ8MTXP02GUR5Y.39.81.H04.1.454.CMB.2.raw
  modified_base (413)..(413): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggtcacacctttacaactatggtatcaggttggtgcgacaggcccctggacaaggcttagaggtggagtggggatggatcgagcgtactttaacgaaatcggtaccaacaaaccaaaacttataccgaccaacaacgaacccctacgaggggaccaggtacgtacaacccgtanacgaccaacgaacacacacaccgaacgacgaccgaccgacctaacgacgtacggaccgtacggaacggacgtaccgtaggacgtactacggtaacgaaccggtaaccggtaccgggtcgttaagttacgttaacgtcggtacggacggaagggtaaacggtaacgggttaaacggggttaaaagtttacgtttacggtaaccgtttaccggttaacccgtttacgttacggttaaccggttaccggggtaccggggtaacccgggtaaccgggtaacccg

SEQ ID NO: 392131 - DNA, 600 bp, Homo sapiens
  misc_feature: GZ8MTXP02IJME6.39.81.H04.1.454.CMB.2.raw
  modified_base (358)..(358): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtacaaagcctgtatacattgataggaaactcctattgaattggttcagcaggagccaggccaatcacaggcctacttaatttagtaacggtttacaaccgggtctcggtgggtacccaagacagacttcgagcggnagggtcgggtcgaggctagtagaacttcgaactactaagaaatcgagacgaggggtgaggtcgtaggaggtagttgggtttaggggtttaattccgtagactagtacgacgtaaacggacacgtacgtcggtcccgttaccgttacgtacggtttacggaccggtaacggggacctaggtacgtagggacgtaactaccgaaaacgcgttggtacggtctaggaccctaaccgtagtttccg

SEQ ID NO: 392132 - DNA, 725 bp, Homo sapiens
  misc_feature: GZ8MTXP02IV4AE.39.81.H04.1.454.CMB.2.raw
  modified_base (275)..(275): a, c, t, g, unknown or other
  modified_base (404)..(404): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaaggcttgagtggatgggatggatcagcgtcttaacaagtggtacacaacaaacgtatcgaccaacgacgaaccctccgaagggccaagacgtccaaccagtacgaacccaanaacgaacctaacatacccaacgacgaccgaaccggtccctaacgagtacggaacccgtagggaacggacggacccgttaggaacggtacttaccgtagggaacccgaaccggtaccgggtacccggttaggttaaacgtttaccggttaggtacgggtaccggaaacgggtacggtaaagggttaaaccggggggtaaaattttacggtttttacgggtaaaccgtttacccgggttaacccctttaacggttttacggaacgtttacccgggtacgggggtaccccggtaaaccgggggttaaacccccggtttccgggg

SEQ ID NO: 392133 - DNA, 635 bp, Homo sapiens
  misc_feature: GZ8MTXP02JD95I.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtacttacgaagtggtacaacgaacaaactatacgaccacacgaaaccctccgaaggggacaaggacgtaccaaccagtacgaaccacaacgacaacgactacccaacgacgaccgaaccggaccctaaacgacgtacggaacccgtaggaacgggaacgcccgtaggaacgtatccgaggaaccgaccgaccgggaccgtaggtaacttacgtcgtgacgaaggagaggtacggggtaaattacgtttacgacgttcggtacccttgtttacgaacgttacggtacgggaccgtaacgggtacccgttacggg

SEQ ID NO: 392134 - DNA, 637 bp, Homo sapiens
  misc_feature: GZ8MTXP02GDK8W.39.81.H04.1.454.CMB.2.raw
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcagtgaaggtctcctgcaaggcttctggttacacctttaccaactatggtatcagttgggncgacaggcccctggacaagggcttgagtgatgggatggatcagcgtcttaacaagtggtacaacaacaaaactatcgaccacacgaacctccgagggaccaagacgtccaacctatacgaaccaacagaaccaacactaccaacgacgaccaaccggacctacaacgtacggaaccctaggaacggaacgcccgtagaacggtataccgtacggaaccgaaccgaacgggtcccgtaggtacttaacgtggtgacgaaggagtaggtacggggtaaaatttacgtttacgaaacttccgggttaacccttaagtttacgaacgttacggtcggggtaccgtaacgggtaacccgttacggg

SEQ ID NO: 392135 - DNA, 572 bp, Homo sapiens
  misc_feature: GZ8MTXP02GDC5X.39.81.H04.1.454.CMB.2.raw
  modified_base (251)..(251): a, c, t, g, unknown or other
  modified_base (264)..(264): a, c, t, g, unknown or other
  modified_base (270)..(270): a, c, t, g, unknown or other
  modified_base (315)..(315): a, c, t, g, unknown or other
  modified_base (336)..(336): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggccaccatctcctgcaggtctagtcaaagcctacgtatacattgataggaaacnctatgattggttnagcagngcagccatcacagcactattatagttcacggatcgtggccagacngactcgagcgacaggtcggcnggcactgaacttcaacacgtaagaaatcgaagcgagggtagggaggacgtggtaggtagttagggtttagggttacttacgtgacgtagtagacgaaagggaccaacgtacgtacggtaccgttaccgttaccgtacgttttacggaccggtaacggggaccgaaggaccggttaggaacgtacgtaaacgtaaacggtaaacgtggtacggacgtacggaccacgtactacttcg

SEQ ID NO: 392136 - DNA, 592 bp, Homo sapiens
  misc_feature: GZ8MTXP02I1EG6.39.81.H04.1.454.CMB.2.raw
  modified_base (267)..(267): a, c, t, g, unknown or other
  modified_base (405)..(405): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgataggaaacactacttgaattggttnagcaggaggccaggccaatctaccaaggctaccttaaatttataaggtttctaaccgggactcgtggggtcccagacagattcgagcgcagtggtcaggcactgaaattcacactagaaactcagcgagggtggaagngtagagggattgggtttaggggtttactacgtgactagttgagaaacggtaacacgaacgtcgggtacccttacggtacttacgtttacggggaccgaacgggggtaacccaggtaccgtagggaaacgtaactaaccgaaaaacgtactgggtaacgtacgtcgaccacctattcgttacgtttcc

SEQ ID NO: 392137 - DNA, 592 bp, Homo sapiens
  misc_feature: GZ8MTXP02I6FHX.39.81.H04.1.454.CMB.2.raw
  modified_base (350)..(350): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatggaaacacctattgaattggttcagcagagccaggccaatctccaaaggcgcctaaatttataaggtttcaaccgggactcgtggggtcccagacagattccagcgnagtggtcagggcagtgaattccacactgaaaactcagacgaggggtaggaggcgtaggaggtagttggtttagggtttagttacgttagactagtagtacgaaggaacaacgacgtcgcctaccgtaacgtacgtttacggaccgtaacgggaaccgaacggtacgtacgggaagtaacgtaacgaaaaccgtacgtacgtaacggtacgttacgtaacctaagtacgtcgttactttaccg

SEQ ID NO: 392138 - DNA, 597 bp, Homo sapiens
  misc_feature: GZ8MTXP02FNQMH.39.81.H04.1.454.CMB.2.raw
  modified_base (331)..(331): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacccttttaccaacttatggtatctagttgggtgcgacaggcccctggacaagggcttgagtggatgggatggatcagcgtcttanaatggtacacaacaaactatcgaccaacacgaaaccctccgaggggctagcgtccaaccatcgaacccagaacgacacactacccacgacgccacgacctaacatacggacctaggaggacgccgagacgaactcgtacgacgaccgacgggccgtaggttactacgtgtagcgagagagtacggggtaaatttagtttacgtaacgttcggttaacccttcgtttacgtacgtacggttacgggaccgtaacgggaacccttcgg

SEQ ID NO: 392139 - DNA, 580 bp, Homo sapiens
  misc_feature: GZ8MTXP02J1BYT.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctactgaattggttcagcagacggccaggccaatcctacaaggcaccttaaatttataacggtttcaaccgggactcgtcggggtacccagacagattcgagcggcaggtgggtcagggcactgaacttcaacgactagaaaatcgaagcgtaggggtggaggtcgtagggaaggtagttagggtttaggggtttattacgtggatagtagacgaaaggaacacgacgtggcctaccgtactacgtttcggccgtaacggggaccaacggtcgaggaacgaacgtaacgaaaaccgtaagtcggtacggctacggaccacctattccg

SEQ ID NO: 392140 - DNA, 625 bp, Homo sapiens
  misc_feature: GZ8MTXP02JRW2J.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgaggttgggtgcgacgacggcccctggacgaagggcttggagtggagtgggatggatcgagcgtacttaacaagtggtacaacaacaaactatgacccacacgaacctcgaggacagcgtacacatcgaccacagacacactaccaacgacgaccgaaccggacctaacgacgtacggaacctggacggacgccgtagacgactcggacgacgacgaccggtccgttagtacgttacgtggtcgacggtaaggaggtacggttaacgggggtaaatttacgtttacgacgtttcggttaaccctttgtttacgaaccgttacgggtacggggtacccgtaacgggggtaacccttcggg

SEQ ID NO: 392141 - DNA, 587 bp, Homo sapiens
  misc_feature: GZ8MTXP02HBRUV.39.81.H04.1.454.CMB.2.raw
  modified_base (252)..(252): a, c, t, g, unknown or other
  modified_base (356)..(356): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccttggacacgcccggcctccatcctcctgcaggtctagtcaaagcctgtatacattgatagaaacnctacttgattgttcagcagagccagccaatcacgaggcacttaattagtaaggttacaaccgggtctcggtcgggaccagacagtcctcagcggacaggtggcngggacacgtagtaatcaaactactaaagaaaatcgaaggcggtaggggtagggagtacgtagggtaagggttaggttggggtttagggtttagttacgtgtagagttagacgtaaaggacaacgtcgtacggtaccctacgttacgtacgtttcggacgtaacggggaccaaggcgtagacgtaactaccgaaaacgtacgtgttcggacgacgtaccacgttctaccttg

SEQ ID NO: 392142 - DNA, 714 bp, Homo sapiens
  misc_feature: GZ8MTXP02JJDZG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacgaagggcttggagtggatgggatggatcgagcgtacttaacgaatggtaccacgaacaaactatgacccaacaacgaaaccctccgagggcaaggacgtaccaaccaatcgaaaccaacaacgaacaacactacccgaacgagaccgaaccggtacctaacgagtacgggaacctaggaacgggacgaccgtaggaacgtacgtacgtacggaaccggtaccacccggggtaccgtttacggtaacgtttaaccgtcgggttaacggacggtaaagggtaacggttaacggggtaaaaccgggggttaaaattttaacggtttttacggaacccggtttacgggttaacccccttaacggttttacggaaaccgttacgggtaccgggggtacccgtaaacgggggtaaaccccgtttccggg

SEQ ID NO: 392143 - DNA, 624 bp, Homo sapiens
  misc_feature: GZ8MTXP02G9ZNY.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtcctccctgcccgtcacccttggacagcccggcctccatcctcctgcaggtctagtcaaagcctacgtatacattgatacggaaactacctacttgaattggttcagcagacggccagccaatcacaaggcacttaattataacggttcaaccgggtctcgtacgggtacccagacagacttcgacgcggactaggtcggtacagggctaatacgtaaacttcaacaacgtaagaaaactcgagacgaggggtggagacgtaggaggtagttgggtttagggttattacgtgtacgtagtacgaacgaaggtaaacacgtacgtacggtaccgttaccgtaccgttacgtttacggaccggtaacggggaaccgtaacggtacgtacggaacgtaacgtaaccgtaaaacgtaacgtaaggtacggtacgtacgaccgtaacctacgttacttcg

SEQ ID NO: 392144 - DNA, 614 bp, Homo sapiens
  misc_feature: GZ8MTXP02HEMHX.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacacctttacactatggtatcagttggtgcgacaggcccctggacgaaggcttgagtggagtggagtggatcgagcgtacttaacgaagtcggtacaacaaactaaaactagtacgacccaacgaacgaaacccgtccgaaggggacaagacgtccaaccagtacgaacccaagacgaacctacacgacccaacgacgccgaaccggaccctacgacgtaccggaacctggacggaaccgccgtaaggagtaactcgacggaccgacgaccggtcgtagttactcgtggtacgcgaagaggtaggtaacgggtaaattgtttacgacgtcgttacctcgttagacgtacggtcggaccgtacggtactccgg

SEQ ID NO: 392145 - DNA, 589 bp, Homo sapiens
  misc_feature: GZ8MTXP02F54W3.39.81.H04.1.454.CMB.2.raw
  modified_base (503)..(503): a, c, t, g, unknown or other
  modified_base (565)..(565): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacacgccggcctccatcctcctgcaggtctagtcaaagcctcgtatacattagataggaaacacctacttagtaattggttcagcagacggccaggccaatctacgaagtccgtacttaatttaagtaacggtttaccgtaaaccgggtctcgttacggggtacccagacagtacgttacaggcgacgtaggtgggtcagggcacgttagaacttcgaaactacgtaagaaaactcgaagcggtaaggggtggagtcgaggtaaggtagtttcgggttagggttattacgtgacgtatgacaaaggacacngtacgcctacgtactacgttggacgacgggacaagtcgtaggacacgtaacaacgtacgtgngactacggaccaactcgtcttacg

SEQ ID NO: 392146 - DNA, 610 bp, Homo sapiens
  misc_feature: GZ8MTXP02G9U3H.39.81.H04.1.454.CMB.2.raw
  modified_base (441)..(441): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggcccctggacaagggcttgagtggagtgggatggatcgagcgcttacaatcggtacacaactaaactatgaccacacgaacctccgaggacaagcgtcaccagtacgaccacgacgacacacacccacgacgacaccggacctaacgagtacggaaccnggacggacgccgtagagacttcgacggaccgacgacgggtccgtagtaacgttcgtaggtcgacggtagaggtaggtacggggtaaaattacgtttacgacgtacggtttaacccctgtttacggaccgttacgggtcggggtaccgtaaccggggtaaccccgttcgg

SEQ ID NO: 392147 - DNA, 713 bp, Homo sapiens
  misc_feature: GZ8MTXP02HLRWD.39.81.H04.1.454.CMB.2.raw
  modified_base (215)..(215): a, c, t, g, unknown or other
  modified_base (275)..(275): a, c, t, g, unknown or other
  modified_base (365)..(365): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttctggttacaccttacaactatggtatcgagttgggtncgacgacggcccctaggaccgaaggtcttggagtggagtgggatggatcgagcgtacttaacgaaagttcggtacaacaaactaaaactntcggaaccccaacgaaacgtaaccctacggacggggaccaaggacgtaccaacaatacgaacccacaagaccaacacacccgaacgacgacccaacggaccctaacgaacgttcggaacccgtaggaagggaccgtacccgtaggacgacgttacgacggaaccgaccgaccgggtacccggttagttaaacgttaccgtagggtcgaaccggtaaggaacgggttaacgggtaaacgggggttaaatttaacgtttttacgaaccgtttacggtttaacccgtttcgtttacgtaacggttaccgggttacggggtaccccgaaccggggtttaaacccttaccggg

SEQ ID NO: 392148 - DNA, 580 bp, Homo sapiens
  misc_feature: GZ8MTXP02JXWOE.39.81.H04.1.454.CMB.2.raw
  modified_base (347)..(347): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttgggtgcgacacggcccctggacaagggcttgagtggatgggatggatcgagcgcttacaatggtacacaacaaactntgaccacagaacctccgagggcagcgtcaaccatgaccacagacacactccacgacgccaccggcctaacgatacggacctgaacggacgcctaggacgtatcgaggaccgaccgtaccgggtccgtaggtacttacgtgtcgacgtaggaagtaggtacgggtaaattcgtttacgacgttcggtacccttgtttacgacgttacggtcggggacctaacgggacccctcgg

SEQ ID NO: 392149 - DNA, 629 bp, Homo sapiens
  misc_feature: GZ8MTXP02FTP9O.39.81.H04.1.454.CMB.2.raw
  modified_base (263)..(263): a, c, t, g, unknown or other
  modified_base (405)..(405): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctctgcaggcttctgttacacttacatatgtatcagttggngcgacacggccctggaacgaggcttggagtggagtgggatggatcgagcgtacttagaagtcggtacaacgaacaaactagtcgaccaacgaacgaacctcgaagggacaagagtccaacctagcaaccacacgactacganacccgaacgacgtaccgacccgtactacgacgtacggaccgaggacggtacgccgtagacgtacgttccgacggaacgtaccgacggggtaccgtagttaacgtcgtaggtcgacgaaggtacgaggttaacggtaaatttcgttacggtaccttacgggttaccccttgtttaaccggacgttaaccgggtccgggggtaccaaccggggtacctttaccggg

SEQ ID NO: 392150 - DNA, 668 bp, Homo sapiens
  misc_feature: GZ8MTXP02HWUDB.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagacgtggggcctcagtgaaggtctcctgcaaggcttctggttacacctttaccaactatggtatcgagttgggtgcgacgacggcccctggacaagggcttggagtggagtgggatggatcgagcgtcttaacagtggtacaacaacaaactatcgaccaacacgaacctccgagggccaagacgtcaaccataccgaaccaacgagaaaccaacactacccgaacgacgaccgaacccgggaccctaaccgacgtcggaacccgtaggaacggacgccgtaggaaacgtcgtacccgtaggaaccgaaccgaccgggtacccgttaggtaacttaccgtggtacgaccgggtaaggaacggttaagggttaaacggggtaaaactttaggtttacgaacgtttaccgttaccttaacgtttcgtaaccgttacggtacgggacccgtaacgggtacccgtacggg

SEQ ID NO: 392151 - DNA, 672 bp, Homo sapiens
  misc_feature: GZ8MTXP02HH0JH.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacctaccctttaccaactatggtatcgtaggttgggtgcgacacggcccctaggacgaaggcttggagtggagtgggatgggatcgaggcgtacttaacaagttcggtacaaccaaactaaaactagtacgacccaaacgaaccgtaacccctaccggaacggggaccaagggacgttaccaaaccctaagtccgaaacccaacgaacgaaccaacctaacacccgaacgaacgcccgaaccggacccttaacgacgtacggaacccgtaggaacgggaacgccgtagacggtatacgagaaccgacgaccggtcgtaggttacttacgtgtagacgaggacgaggttacggggtaaattaggtttacgacgttacggttaccctaagtttcgtacgtacggtacgggaccgtaacggggtacctcgg

SEQ ID NO: 392152 - DNA, 733 bp, Homo sapiens
  misc_feature: GZ8MTXP02JJYI6.39.81.H04.1.454.CMB.2.raw
  modified_base (373)..(373): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcgagcgtcttacaagtggtacacacaaactatgaccacacgaacctcaggggcagngtccacatcgaccacagacaacactacccaacgacgaccgaccggacctaaccgacgttacgggaacccttagggaacgggacggtacccgttacggaacggtaagttccggtaacggaaaccggaacccggaacccggggtacccggttaacggtttaactttacggttacggttacgggaccgggtaaaagggtaaacgggtaacgggtttaaacccggggggtaaaaattttaacggtttttacggtaaacccggtttaccggggtttaaaccccctttcggttttacggtaaacccggttaccgggttacggggggtaccccggtaaaacgggggttaacccccgtttaccggggg

SEQ ID NO: 392153 - DNA, 553 bp, Homo sapiens
  misc_feature: GZ8MTXP02G6JKE.39.81.H04.1.454.CMB.2.raw
  modified_base (369)..(369): a, c, t, g, unknown or other
  modified_base (382)..(382): a, c, t, g, unknown or other
  modified_base (390)..(390): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcaacaacaaactagtgaccacagaacctccagggcagngtcacatgaccanagacacanaccacgagcacgctacatgacctgaggacgcctagacgatcgtgacgacgacggccgtagtacttactgtcgcgaagaggacgtacggggtaaattagtttcgaacgttggttaacccttcgtttacgacttacggtggggtacccgacgggtaacccttcgg

SEQ ID NO: 392154 - DNA, 599 bp, Homo sapiens
  misc_feature: GZ8MTXP02JCAYE.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcaggtctagtcaaagcctcgtatacattgataggaaactacctattagaattggttcagcagagccaggccaatccacgaaggcgtacttaatttataaggttactaaccgggtactcgtcgggtccagacagactcagcggacaggtggtcagggcacgtagaattcacactagaaaactcgagcgaggggtggaggtacgtaggaggtagtttgggttaggggtttacttacgtgacgtagtacgacgaaacgggaacacgtacgtcggtcccgttaccggtactttacggtttacgggaccggaaacggggtaccaaaggtccgtagggaacgacgtaaccgaaaacggtacgtggtacgcgtacgactacctagttcgtttcg

SEQ ID NO: 392155 - DNA, 691 bp, Homo sapiens
  misc_feature: GZ8MTXP02HFRTN.39.81.H04.1.454.CMB.2.raw
  modified_base (279)..(279): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctctgcaaggtcttcgtggttacctacctttaccaacttatggtatcgaggttggngcgacgacggcccctggacgaagggtcttggagtggagtggggatggactcgagtcgtcttaacgagtcggtaccaacaaactaaaccgtgtacgaccctaacgacgaaacccctcgaggggacaacgtcggtaccaaccgtatacgaacccacgaagaacccaacaactacccgaaacgagacccgaaccgggtacctaacgaacgtacggaaccgtaggacggaacgccgtaaggactatccgtaggaaccgaccgaaccgggtcttagtaacgttcgtagtcggacggtaaagacggtaacgggttaacggggttaaaatttggttttaccggacgtttccggttaaaccccgttggttaacgtaccgttaacggggtccggggaacccgtacggggttaacccgtcgg

SEQ ID NO: 392156 - DNA, 673 bp, Homo sapiens
  misc_feature: GZ8MTXP02JB045.39.81.H04.1.454.CMB.2.raw
  modified_base (366)..(366): a, c, t, g, unknown or other
  modified_base (577)..(577): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacctacctttacaactatggtatctaggttgggtgacgacacggcccctaggacaagggtcttggagtggatgggatggatcgagcgtacttaacaagttcggacaacaactaaaacttancgacccaacacgaaaccctccgaagggacaagtaccgtcaaacctagtacgaacccaagaacgaacctaacactacccgaacgacgaccgtaaccggaccctaaccgaaggttccggaaaccgtagggaccggaaacgcccgttaaggacggtaacttcccgtaaggaaccgaccgaccgggtaccgtttaggttaacttacgtgaccggngaaggaagtaggtaacgggtaaatttacgttgtaaccgtcggttaaccccttgttacgtaacgttcgggacgggaccgtaacggggtaacctcggg

SEQ ID NO: 392157 - DNA, 619 bp, Homo sapiens
  misc_feature: GZ8MTXP02F0DXM.39.81.H04.1.454.CMB.2.raw
  modified_base (275)..(275): a, c, t, g, unknown or other
  modified_base (348)..(348): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacacggcccctggacaagggcttgagtggatgggatggatcgagcgcttacaagtcggtcaacacaaactntgaccacgacgaacctcgagggcagcgtcacatcgaccagacgacacactaccgaacgacgactaccggacctacgagttacggacctaggacggacgtacccgtagacgtaactcgtacggaaccgtaaccggaccggtccggttagtaacgttaccgtggtacgacggaaggtacggtacggtaacggggtaaatttacgtttacgaccgttccgttaccctgtttacgaacgttacgggtcggggtaccgacgggtacccgttaccgg

SEQ ID NO: 392158 - DNA, 629 bp, Homo sapiens
  misc_feature: GZ8MTXP02GDDH3.39.81.H04.1.454.CMB.2.raw
  modified_base (277)..(277): a, c, t, g, unknown or other
  modified_base (399)..(399): a, c, t, g, unknown or other
  modified_base (517)..(517): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatctaggttggtncgacaggccctggacaaggcttgagtggatgggatggatcgagcgtacttaacgaagtcggtacaacaacaaaacgtatcgaccacgaacgaacctcgagggcaagcgtcaccatcgaccanagacacactacccgacgacgccgaccgacctacgagtacggacccgtaggacggacgccgtaggaagtactacgtacggaacccgtacgacgggtaccgttaggttaacctttacggngttacgggacgaggaacggtaacggtacggggtaaaatttggtttacgaccgttcggttaccccttgttacggaccgttacggtcgggaccgtaacggggtaccctttcggg

SEQ ID NO: 392159 - DNA, 682 bp, Homo sapiens
  misc_feature: GZ8MTXP02IJPSS.39.81.H04.1.454.CMB.2.raw
  modified_base (327)..(327): a, c, t, g, unknown or other
  modified_base (398)..(398): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgacttanaatggtacacaacaaactatgacccacaagtaaccctccgaggggaccagtagtccaccaatcgacccaanacgaacacactacccgaacgacgaccgaaccggtacctaacgtacgtacggaaccgtacgggacggtacgtaccgtaggaacgtacgtacgtacggaaccgaaccggtacccgggtaccggttacgttaacgtttaccggttaggtaccggaacgaaggtaaggtaaacggttaacgggggttaaaatttacggtttaacgtaccgtttacccggtttaacccgttaacgtttacggtaaccgttaacgggtcggggaacccggtaaaccgggtacccgttcgg

SEQ ID NO: 392160 - DNA, 633 bp, Homo sapiens
  misc_feature: GZ8MTXP02GCMVJ.39.81.H04.1.454.CMB.2.raw
  modified_base (359)..(359): a, c, t, g, unknown or other
  modified_base (534)..(534): a, c, t, g, unknown or other
  modified_base (541)..(541): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctagttgggtgcgacacggcccctggaccaagggcttggagtggatggggatggatcgagcgcttaacgaattcggtacaacaaactaaactancgaccaacaacgaaaccctcgaaggggccaaggacgtcaccgatacgaaccaacacgaacaaccaagtaccccaagacgaccgaaccggacctaacgagtaacgggaccctaggacgggaacgtcccgtagacggtaatcgaggaccgaccgacggtccgttacgtaagttccgnggtacgnggaaagtaggaacgtacgggggtaaaattggtttacgaacgttcggtaacccttgttacgtaactacgtcggaccgaacgggtaccctcggg

SEQ ID NO: 392161 - DNA, 581 bp, Homo sapiens
  misc_feature: GZ8MTXP02G1UX6.39.81.H04.1.454.CMB.2.raw
  modified_base (250)..(250): a, c, t, g, unknown or other
  modified_base (283)..(283): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctatgaattggttcagcagagcaggccaatcncaaggcactaattataaggttcaacgggactcgtgggtacccagacagacttcgagcgcaggtgggtcagggcacgtgaattccgaactacgtaagaaaactcgaaggacgaggggtaggaggtacgtggaaggtagttgggtttaggggtttacttacgtgacgtagtagacgaaagggaacacgtacgtcggtaccctaccgtacgttacgtttcggaccggtaacggggaccaagccgtaggaacgtacgtaacgaaacgtaacgtggtacggctacggactactacgtcttacg

SEQ ID NO: 392162 - DNA, 663 bp, Homo sapiens
  misc_feature: GZ8MTXP02ILR6G.39.81.H04.1.454.CMB.2.raw
  modified_base (273)..(273): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctgttactaccttaccactatgtatctagtggtncgacacggccctggacgaagggtcttaggagtggagtgggatggatcgagcgtacttacgaagttcgtacaactaacaaactatcgaccaacacgtaaccctccggaaggcagacgtccaacgtactaccgaacccagaaacgaaccaacactacccgaagaacgccgacccgacctaacgagtacggaccgtaggaacggtacgaccgttaggaaacgtacgttaccgacgggaaccccgaccgtaccgggttacggttagttaacgttacgtggtacggacggtaaggacggtaacggttaaacgggttaaaagttcgttttacgacgtttccggttacccttaagttacgacgttacggaccgggtaccgtaaccggtaccgtacgg

SEQ ID NO: 392163 - DNA, 632 bp, Homo sapiens
  misc_feature: GZ8MTXP02ILN9I.39.81.H04.1.454.CMB.2.raw
  modified_base (293)..(293): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtctccctgcccgtcacccttggacacgccggcctccatcctcctgcaggtctagtcaaagcctgtatacattgataggaaactacctattgtaatttggttcagcagacgcaggccaatcncaaggcacttaattagtagtttacacggactcgtggtaccagacacgtatcgacgcggcagggttgggcgaggccacgtagtaattccgaaactaactaagtaaaactccgaaaggtcggagggggtgagggtcgttagggaggtagttgggtttaaggggtttattacgtgtacttagacggtaacgaaacggacgaaccgtaacgtccgggtcccttaaccgtacgtacgtttcggacccggtaacggggaacgtaaccgaggtacggtaacgaacgtaaaccgaaacggtaacgtaacgggtcggtaacgtcgtacctaacccgttaacggttccg

SEQ ID NO: 392164 - DNA, 808 bp, Homo sapiens
  misc_feature: GZ8MTXP02JDV28.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctcatctcctgcaggtctagtcaaagcctacgtatacattgataggaaacacctacttagaattggtttcagtcgaagacggcccgacggaccaactacccccgaaaggccgtaccttaaagtttaagttaaacggttttaccgtaaaacccggggtaccgttccggtacggggttaccccaacggtaaccgaaggtaactttaccgaacggtaccggacgaggtttttttacggggaccgaacgggccgtaaaccgttaggtaaaccgtttaccaaaccgtaaccgtttaaaggaaaaacgttacccgtaaaggaaccggtaagggggttaagggacggggttaccgtagggtaagggttaacggtttagggtttttagggggttttaacgtttaaccggttaggtaccgttaaagtacggtaacgtaaaacgggaaacctaccgtaaacgtccggttacccgttacccggttaacgttaaccggttttacgggacccgggtaaacggggacccgtaaacggtaccgttagggaaacgtaacgttaaccgaaaacgtaaccgttaggtcggtacgttacggtacaaccgtacttcgtacgtttacccg

SEQ ID NO: 392165 - DNA, 598 bp, Homo sapiens
  misc_feature: GZ8MTXP02FED6F.39.81.H04.1.454.CMB.2.raw
  modified_base (350)..(350): a, c, t, g, unknown or other
  modified_base (393)..(393): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacaactatggtatcagttggtgcgacacggcccctggacaagggcttggaggtggagtgggatggatcgagcgtcttaacaatggtacaacaacaaactntgccaacgacgaaacctcgagggcagacgtcaccatcgaccanacgacacatcccagacgcacgcctacatcgggacctagggaggacgccgtaggacgacttacgtacgggaaccgtaccgaccgggtccgttaggttacttacgtgtagacgaagaggtaggtacggggtaaaattagtttacgacgttcggttaacccctgtttacggaacttacggtacggggacccgaacggggacccttcgg

SEQ ID NO: 392166 - DNA, 676 bp, Homo sapiens
  misc_feature: GZ8MTXP02HYPYO.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttacactatgtatcagttgggtgcgacacggcccctggacaagggcttgagtggagtgggatggatcgagcgacttacaagtggtcaacaacgtaaaactatcgacccaacgtaacgaacctccgaacggggacaaggacgtaccaaaccctaattaccgaaacccaacaaacgaaacccaaccaaactacccgaacgaacgcccgaacccgggtaccctaaccgacgtacggaacccgtggaacgggacgcccgttaggacgtacgtacgttacggaaccgtaccgaccgggacccggttagttaacgtttacgtggtcggacgaacggtaggtaagtacgggggtaaattacgttttcggaacgttcgggtaccctttgttacggtaacgtacggtcgggtaccgtacggggtaacccttccggg

SEQ ID NO: 392167 - DNA, 591 bp, Homo sapiens
  misc_feature: GZ8MTXP02HA00U.39.81.H04.1.454.CMB.2.raw
  modified_base (304)..(304): a, c, t, g, unknown or other
  modified_base (321)..(321): a, c, t, g, unknown or other
  modified_base (406)..(406): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctcatctctgcaggtctagtcaaagcctacgtatacattgataggaaacacctattgaattggttcagcagaggcaggccaatcacaaggctactaaatttanaaggtttcaaacgggtntcgtggggtacccagacagtatcagcggcaggtgggtcaggcacgtagaattcaactactagaaaatcgaagcgaggggtgagtntaggaggtagttgggttacgggtttaaatcgtggatagtgacgaaacggaactacgacgttacggacccttacgtacgttacgtttcgggaccgtaacggggacctaaaggccgtaggggaaacaacgttaaaccgaaaaacgtccgtaggtaacgtcgtaccgaccgtaacctaacgtttcccg

SEQ ID NO: 392168 - DNA, 644 bp, Homo sapiens
  misc_feature: GZ8MTXP02JUTID.39.81.H04.1.454.CMB.2.raw
  modified_base (336)..(336): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgtaggttggtgcgacacggcccctggacaagggtcttggagtggagtgggatggatcgagcgtcttaanagtggtcaacaactaaactgtcgaccacagaaccctcgaggacagacgtaccaacagtacgaaccaagacgacaacactaccgacgacgccgaaccggacctaccgagtacggaacccgtaggaacggacgtacccgtaggaacgtactaccgtacggaaccgaccggtaccgggtcccggttagttaacttcgtaggtcgacggtagaggtacgggtaacggggtaaattacggtttacgacgttccggttaaccttcgttacgtaacgttacggtacggggtaccgtaacggggtacccttccggg

SEQ ID NO: 392169 - DNA, 599 bp, Homo sapiens
  misc_feature: GZ8MTXP02H5637.39.81.H04.1.454.CMB.2.raw
  modified_base (291)..(291): a, c, t, g, unknown or other
  modified_base (398)..(398): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcaccttggacagccggcctcatctcctgcaggtctagtcaaagcctgtatacattgatggaaacacctacttgaattggtttcagcagaggccaggccaatctcaaggcncctaaatttataaggtttcaaccgggactcgtggggcccagacagattccgagcggctaggtgggtcaggcactggaaacttcgacactagaaaatcagcgaagggnggagcgtaggaggtagttgggtttaggggtttatacgtgacgtatggacgtaaaggaaccacacgtcggtacccttccggtaaacttcgtttacgggaccgtaaacgggggaaccctaaagggtcgtagggaaacgacgtaaccgtaaaaaccggtacgttagtcgggtactacggacctaactacgttcgttacgtttcc

SEQ ID NO: 392170 - DNA, 633 bp, Homo sapiens
  misc_feature: GZ8MTXP02G596X.39.81.H04.1.454.CMB.2.raw
  modified_base (256)..(256): a, c, t, g, unknown or other
  modified_base (268)..(268): a, c, t, g, unknown or other
  modified_base (273)..(273): a, c, t, g, unknown or other
  modified_base (375)..(375): a, c, t, g, unknown or other
  modified_base (393)..(393): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacaccttacactntgtatcagtggncgacngccctggacaggctgagtggatgggatggatcgagcgtacttacaagttggtacacaactaaactatgacccaacacgaaccctcgagggcagcgtacacancgaaccacagaccacacncccgacgacgaccgtaccggaccctaacgacgtacgggaacccgtggaacgggaacgcccgtaaggaacgtaacgtccgtacggaaccgaaccggaccggtacccggttagttacgttacgtggtacgacggaaggagtaggttacggggtaaaatttacgtttacgaaccgttcggtttacccttaacgtttacggaaccgtttacgggacgggtacccgaccgggtaacccgttccgg

SEQ ID NO: 392171 - DNA, 705 bp, Homo sapiens
  misc_feature: GZ8MTXP02GWYL5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttaccaactatggtatctaggttggtgcgacgacggcccctggacaaggtcttggagtggagtgggatggatcgagcgtacttaagaagtggtaccacaaactaaactatcgaccaacgaacgtaaccgtcgaaggggaccaaggacgtaccaaaccagtacgaacccaacgacgaaaccaacgactacccgaacgacgaccgaaccggacctaacgaacgtaccggaaccgtaggaacggacgtaccgttaggaacgtagtaccgtacggaaccgaaccgtaccgggtccgttagttaacgttaccgtaggtacggacggaacggtacggtaagggttaaacgggttaaaacgtttaggttttacgtacccgtttacggtttacccctttaagtttacggtaaccgtttacgggtaccggggtaacccgtaaccggggttaacccgttccggg

SEQ ID NO: 392172 - DNA, 737 bp, Homo sapiens
  misc_feature: GZ8MTXP02JH8I9.39.81.H04.1.454.CMB.2.raw
  modified_base (368)..(368): a, c, t, g, unknown or other
  modified_base (419)..(419): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgctcactcccaggttcagctggtacagtctggagctgagatgacgaagccgtggggcctcagtgaaggtctcctgcaaggtcttcgtgttactacctttaccaactatggtatcgtaggttggtgcgacgacggccccgtaggaacgaagggtcttggagtggagtgggatggatcgagtcgacttacgaagtcggtacaacgaactaaactntacgacaacgtaacgaacctccgaagggcagacgtacaccagtcgaaccanacgaactacactacccaagacgaccgacgaccctacgagtacggacaggaacggcgtaccgtagacgtacttaccggacgaaccgtaaccggacccgggtacgtttaacgttaacgtttaaccgggtcggtaacggtaacgggtaaggtaaagggttaaacggggttaaaacggggtttaaaactttttacgggttttaacccggttacccggtttacccgggttttaaccccgtttacggttttaaacccggtaaccgggttaacccggggttaacccgggggtaaccccggggttaaaacccggggtttaccccgg

SEQ ID NO: 392173 - DNA, 552 bp, Homo sapiens
  misc_feature: GZ8MTXP02JG1Z6.39.81.H04.1.454.CMB.2.raw
  modified_base (324)..(324): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatggatcagcgnttacaatggtcacacaaactatgaccacagacctcagggcagngtcacatcgaccacagacacactccacgagcaccgcctacacgtcggacctaggacggacgccgtaggacgtatctaggaaccgacgaaccggccgtgtactactgtgcgagagagtacggggaaattacgtttagacgttgttaccctgttacgtactacggtcgggacgacggtacccgtcgg

SEQ ID NO: 392174 - DNA, 608 bp, Homo sapiens
  misc_feature: GZ8MTXP02JIFJZ.39.81.H04.1.454.CMB.2.raw
  modified_base (529)..(529): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatggggatggatcgagcgtcttaacaagtggtaccacaacaaaactatcgacccacaacgaaccctccgaaggggccaagacgtaccaaccagtacgaaccaacgaacgaacctaacactacccgaacgacgccgaacccggacctaacgacgtacggaacccgtggaacggtacgccgtaggacgactcgtacggaacgaccgacggtccgtagtacttacgngtagacgagagagtacgggaaattgttacgacgttcgtacctgttacgacgttacggcgggacctaacgggaccctcgg

SEQ ID NO: 392175 - DNA, 621 bp, Homo sapiens
  misc_feature: GZ8MTXP02IOIPM.39.81.H04.1.454.CMB.2.raw
  modified_base (215)..(215): a, c, t, g, unknown or other
  modified_base (386)..(386): a, c, t, g, unknown or other
  modified_base (403)..(403): a, c, t, g, unknown or other
  modified_base (457)..(457): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttctggttacacctttacaactatggtatcgtagttgggtgcgacacggcccctggacaagggcttgagtggagtgggatggatcaggcgtacttacgaatcggtacaactaacaaactatgaccaacgacgaaccctcgaggggcaagngtcaccatacgacccanaacgacacatacccacgacgccaaccggacctacgaatcggaacctgacggacnccgtagagactcgtaggaaccgaccgaccggtcgtagttaacgttcgttaggtcgacggaagacggtaggtaaacgggggtaaaatttaggtttacgaaccgtttcggtaacccttgtttacgacggttacgtacgggggtacctaacggggtacccgttacgg

SEQ ID NO: 392176 - DNA, 641 bp, Homo sapiens
  misc_feature: GZ8MTXP02HED2Y.39.81.H04.1.454.CMB.2.raw
  modified_base (426)..(426): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcacaacaaactatgaccacaacgaacctccgagggccaagagtcaccatcgaaccacagacacataccacgagcaaccgctacgatcggaaccgngacggacgcctaggacgtactcgtacggaaccgaaccgaccgggtccgttaggttaacgttacggttaggtacggacggaaggtacggtaaacgggttaaacggggtaaaatttacgttttacggaaccgtttaccgggtttaacccctttcgtttaacggtaaccggttacgggtaccgggggtaacccggtaaccggggtaaacccgttcggg

SEQ ID NO: 392177 - DNA, 781 bp, Homo sapiens
  misc_feature: GZ8MTXP02IRIZ3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctgttacaccctttacaactatggtatcgtaggttgggtcgcgacgacggccccgtggacgaaggtcttggaggtggatgggagtggatcgagcgtcttaacgaagttcggtacaacgaaactaaactatgacccaaccgaacgaaccccgtaccgaggggaccaaggtacgtccaaccgtaagtaccgaacccaaacgaaacgaaaccaaaccgtaccgtaacccgaaacggacggacccgaaacccgggtacctaacccgagttaccgggaaccgttagggaacgggtaccggaccgtaagggaacggtacttaccgacggaaacccgacccggaacggttcccggttaaggtttaaacgttccgtagggtacggacggtaaaggtacgggtaaacgggttaaaccgggggttaaaaatttttcggttttaacgggttaaacccgtttccgggtttaaaccccgttaacgttttacggtaacccggttttaccggggacgggggtaacccggtaacccgggggttaaaccccgtttcccggg

SEQ ID NO: 392178 - DNA, 674 bp, Homo sapiens
  misc_feature: GZ8MTXP02HN1W8.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgtacttacaatcggtcaacgaacaaaactgtacgacccaacgaacgaaccctccgaggggaccaaggacgtaccaaccctagtaccgaacccaacgaacgaacccaacaactacccaaacgacgccaaccggccctaaacgacgttacgggaaccctaggaacgggacgtcccgttaggaacgtataccgtacggaaacccgacgacccgggtaccgttaggttacttacgtggtacgacggaaggtacggtaggtaacggggttaaaatttacgttttacgaaccgtttcggttaccccttcgtttagaaccgttacggtcgggggtacccgaacggggttaacccgttcggg

SEQ ID NO: 392179 - DNA, 702 bp, Homo sapiens
  misc_feature: GZ8MTXP02F2V9L.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaactatggtatcaggttgggtgcgacgacggccctggaccgaagggtcttgaggtggagtgggatggatcgagcgtacttaacgaagttcggtacaacaacaaaatatacgacccaacgaacgaaccctaccggaagggaccaagacgtaccaaccgtagtaccgaacccaacgacgaacccaacaacctacccgaacgaacgaccgaacccggtacctaacgaagtaccggaacgacggaggaccgtaccgtaggacgtacgtcgtacggaaccgaaccgaccgggttaccgttagttaacttacgtagtacggacggaaggtacggtaaggttaaacgggggttaaaatttacggttttacgtaaccgttaccggtttacccgttaacgtttacggtaaccgttacgggtacggggacccgtaaccggggtaacccgttaccgg

SEQ ID NO: 392180 - DNA, 638 bp, Homo sapiens
  misc_feature: GZ8MTXP02JG7YY.39.81.H04.1.454.CMB.2.raw
  modified_base (358)..(358): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacctttacactatggtatcgtagttggtgcgacacggcccctggacaagggcttggagtggagtgggatggatcgagcgtcttaacgaagttcggtacacgaactaaactntacgacccaacgacgaacctaccgaggacaagtacgtcaacagtacgaaccaacgaacgactaaccactacccaacggaacgacccgtaccggacctacgaacgttacgggacctagggacggacgtacccgagacgtacgtcgtacggaaccgtaccggacggtcgtagttaatccgtagtgacggtaggacgtaaggtacgggtaaattacggtttcgaacgttccggttaccttgtttacgaacgtacggtacggggaccgtaaccgggtccttcgg

SEQ ID NO: 392181 - DNA, 661 bp, Homo sapiens
  misc_feature: GZ8MTXP02JHEY7.39.81.H04.1.454.CMB.2.raw
  modified_base (522)..(522): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaggcttctgttactacctttaccaatatggtatcgaggttgggtgcgacacggcccctaggacaaggcttggagtggatgggatggatcgagcgtacttaacagtcggtacaacaacaaactatcgacccaacgacgaacctcgagggacagtacgtacaccagtacgaccacgaacgacacactacccaacgacgacgaccggtaccacgtagtacggaccgtaggacggacgccgtagacgtaactccgtacggaaccgaccgaccgggtcgttagttactttacggngtacgacggtaacggaaggtaacgggttaaacgggttaaatttacggtttacggtaccgtttaccggttacccgttaacgtttaacggtaaccggttaccggggtaccggggtacccggtaaccgggtaacccggtcgg

SEQ ID NO: 392182 - DNA, 718 bp, Homo sapiens
  misc_feature: GZ8MTXP02JIQGI.39.81.H04.1.454.CMB.2.raw
  modified_base (216)..(216): a, c, t, g, unknown or other
  modified_base (232)..(232): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctnagtgaaggtctccttnaaggtcttctggttacacctttaccaactatggtatcgtaggttggtgcgacacggcccctggacaagggtcttggagtggagtgggatggatcgagcgtacttaacgaagtcgggtaccaacgaactaaaactntacgactaacccgacgaaacccctcgaaggggaccaaggactccaaccatacggaaccccaagacgaaccaacactcccgaaacggacgaccgacccgggtacccttaacgacggttaccgggaacccgtagggaacggacgacccgtaggaacgtacttcgacggaccgtaaccggaccggtaccggttagttacgttacgtggtacggacggtaaggtacgggtaacggttaacgggggtaaaactttacggttttacggtaccgtttaccggttaccctttacgtttaacggaccggttacgggtccgggggaccgtaaccggggtacccgttacggggttacccccg

SEQ ID NO: 392183 - DNA, 669 bp, Homo sapiens
  misc_feature: GZ8MTXP02FXDMZ.39.81.H04.1.454.CMB.2.raw
  modified_base (204)..(204): a, c, t, g, unknown or other
  modified_base (211)..(211): a, c, t, g, unknown or other
  modified_base (330)..(330): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgagccngggcctnagtgaggtctcctgcaaggcttctggttacacctttacaactatggtatcgaggttgggtgcgtacacggcccctgggaccaagggcttagagtggatgggatggatcgagcgtcttanaagtggtacaacaacaaagtatcgaccaaccacgtaaccctccgaggggaccaagacgtaccaaccgatacgaacccaacgagaacctacaacacccgaacgaacgaccgtaaccggtaccctaaccaagttcgggaaccctaggaacgggaacgtacccgtaggaacggacttacgacgggaacgaaccggtaaccgggtacccgttagttaacgttttacggtaggtacggaacggtaaaggtacgggtaacggttaaacggggttaaatttacggtttacgtaccgttccggttaacccttgttacgtacgtacggtacggacgtaacggtactcg

SEQ ID NO: 392184 - DNA, 616 bp, Homo sapiens
  misc_feature: GZ8MTXP02GDXOQ.39.81.H04.1.454.CMB.2.raw
  modified_base (348)..(348): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggggtgcgacaggcccctggacaagggcttggagtggatgggatggatcagtcgcttacaatggtacacaacaaactntcgaccacaacgaaccctccgaggggccaaggacgtcaacccagtacgaacccaacacgaccaacactacccacgacgccaaccggaccctacagtcggacctaggaacggacgacctaggacgatcgtacggacgaccgacgggtccgtaggttacttacgtgtcggacgagaggagtacgggggtaaattacgtttacgacgttacggttacccttcgtttacgacgttaccggtacggggtaccgaacggggtacccgttaccgg

SEQ ID NO: 392185 - DNA, 599 bp, Homo sapiens
  misc_feature: GZ8MTXP02JAA1I.39.81.H04.1.454.CMB.2.raw
  modified_base (322)..(322): a, c, t, g, unknown or other
  modified_base (368)..(368): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgnttacaatggtcacacaaactatgaccacagaacctccgaggccagntcaccatgaccacagacacactcccacgacgcacggacctaccatacgggaccctaggacggtacgcctaggacgtactcgtacgggaaccgacgacgggtccgtagtacttacgtgtgacgtaaggagtaacggtacgggggtaaaatttacgttttcgaaaccgttcggttaaccccttgtttacgaccgttacggtcggggacccgtaacggggtaaccgtttccggg

SEQ ID NO: 392186 - DNA, 636 bp, Homo sapiens
  misc_feature: GZ8MTXP02HBB1V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacaagggcttggagtggatgggatggatcgagcgtcttaacatggtacaacaataaactatgaccaacacgaaccctcgagggcagcgtaccacatcgaaccacagaccacactacccaacgacgaccgaaccggacctaacccgaagtacggtaacccgtgggaacggaacggcccgtaggaacgtacgtacgtaccggaaccggaaccgaaccgggtccgttaagttaacgttaccgtaggtacggacgtaaggacgaaggttacgggggtaaaatttcggtttacgaacgttcggttacccttgttacgtacgtcggtacgggaccgtacgggtaacccttcgg

SEQ ID NO: 392187 - DNA, 683 bp, Homo sapiens
  misc_feature: GZ8MTXP02HKX1K.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctattgaattgttcagcagaggccaggccaatccacaaggcgaccttaaatttagtaacggtttcctaaacccggggtactcgtacggggtacccagtacagtactacgagcggctaggtgggtcagggccacgtagtaaacgtttccaacgtaactagaaaaactcgaaacggtcggaaggggttaggggaacgggacgtaggggtaagggtaggtttaggggtttagggggttttaactttacgtggtacctaagtttcgggaacgaaacgggtaaaccaaccgtaccgttaccgggacccgttaccggttaaccgttacggttttacggaaccccgggtaacggggtaacccgaaaggtccggtaggtacgtaacgtaacgtaaaaccggtaacgtcggtacggacgtcggacctaccgtacttcgttcg

SEQ ID NO: 392188 - DNA, 624 bp, Homo sapiens
  misc_feature: GZ8MTXP02GQ72J.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccaggtggggatgttgtgatgactcagtctccagtcctccctgcccgtcacccttggacacgcccgcctccatcctcctgcaggtctagtcaaagcctagtatacattagatacggaaactcctatgaattggttacagcagacggcagccaatctacgaggctacttaattagtaacggttcaacgggtctcgtgggtccagacagtactcgagtcggctaggtgggtacagggactacgtagaaacttcaacaacgtaagaaaactcgaaaggcgaaggggtaggaaggtcgtaggagggttagttgggtttaggggttattacgtgactaggtacgaacgaaacggaacaccgtacgtcggtaccgttaccgtaacgttcgtttacgggaaccgtaacgggggtaccgaagtacggtaggtaacgaaacgtaacgtaaaacggacgtggttacggacctacggccctaaactacgttcgtttaccg

SEQ ID NO: 392189 - DNA, 710 bp, Homo sapiens
  misc_feature: GZ8MTXP02GOEGQ.39.81.H04.1.454.CMB.2.raw
  modified_base (277)..(277): a, c, t, g, unknown or other
  modified_base (282)..(282): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacacctttaccaactatggtatcgtagttgggtncgacncggcccctggacaagggcttggaggtggagtgggatggatcgagcgtcttaacgaagtcggtaccaacgaaactaaaactagtacggaccccaaccgaaacgtaaaccccgtaccggaaggggaccaagggtaccgtaccaaacccaacgttaccgaaaccccaaacgaacggaaacccaaaccaacctaaccccgaacggaaccggacccgaacccgggaccctaaccgacgttaccgggaacccgttagggaacgggtaaccgcccgtaggacgtacgtaccgtacggaaccgaccgacgggtaccgttagtacgttacgtggtacgcgtaaggacggtaggtaacggggtaaatttacgttacgtacgttacggttacccttgttacgtacgttacggtacgggaccgtacgggtacccgtccgg

SEQ ID NO: 392190 - DNA, 663 bp, Homo sapiens
  misc_feature: GZ8MTXP02GXC5F.39.81.H04.1.454.CMB.2.raw
  modified_base (214)..(214): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgaagtctctgcaggtcttcgtgttactaccttaccaacttatgtatcgtagttgggtgcgacgacggccctggaacgaaggcttggagtggagtgggagtaggatcgacgcgtacttaacaagttcggtacaaacgtaaactaaacgtatcgaacccaacgaacgtaaccctacggaagggacaacgacgtaccaacaacgaccgaaccaaacgaacgaaccaactaacgacccgaaacgacgacccgacggaccctaacgacgttacggaccgtaggaacggacgtaccgtaggacggtatacgacgaaccggaaccgaccggtcgttagttaacgttacgtggtacgacggtaacgaggtaggtaacgggtaaatttacgtttacgacgtttaccgttaccgttgttacgacgttacggtccggacgtaccggtaccgttccgg

SEQ ID NO: 392191 - DNA, 679 bp, Homo sapiens
  misc_feature: GZ8MTXP02GVDIU.39.81.H04.1.454.CMB.2.raw
  modified_base (270)..(270): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggtacacctttacactatgtatcagttggtncgacacggcccctggacgaaggtcttagagtggagtgggagtggatcgagcgtacttacgaagttcggtacaacgaactaaactacgtagaccccaacgaacgaaccctccggaaggggccaaggtacggtaccaaaccgtaactaccggaacccaacgaacgaaccaaccacgtacccgaacgacgaccacccgggacctaaccgcgtacggacctagggacggacgccgtagacggtctacgtacggaaccgaaccgaccggttaccgtagttaacgttacgtggtacggacggaggtaggtaagggttaaccggggtaaattacggtttacggaaccgttcggtttaaccccgttgtttacgaccgtttacggacggggttacccgaacgggtaaccccgtttcgg

SEQ ID NO: 392192 - DNA, 670 bp, Homo sapiens
  misc_feature: GZ8MTXP02FN2XQ.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcaggttggtncgacaggcccctggacaaggcttgagtggatgggatggatcgagcgacttacaagtggtacaactaacgaaaactatagacccaacgacgaaaccctccggaaggggaccaaggacgtaccaaccgtaagccgaacccaacaacgaacctaaacacttaacccgaacgacgaccaacccgggaccctaaccagttacggaaccctagggacggaaacggcccgtaggaacggtactcgtacggaacgaaccgaaccgggtccgttaggttaacttcggtgtcggaagtaggaacggtacggtaagggggtaaaactttagtttacggaaccgttcggttaacccttgtttacggaacgttacgggtacgggtaccggaacgggtacccgttcggg

SEQ ID NO: 392193 - DNA, 617 bp, Homo sapiens
  misc_feature: GZ8MTXP02I7VHF.39.81.H04.1.454.CMB.2.raw
  modified_base (277)..(277): a, c, t, g, unknown or other
  modified_base (348)..(348): a, c, t, g, unknown or other
  modified_base (382)..(382): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttacaactatggtatcaggttggtncgacgacggccccgtggacaaggctgagtggatgggatggatcgagcgtcttacagtggacaacacaaatncacacaagacctcgaggcagctcacatcgaacananacacancacgancacgccacagtacgaccgtagacggtacgaccgtagagacttacgacgaaccgacgaccggggtccgttaagttacgttacgtggtacggacggtacgaaaggtaacggtaacggggttaaaatttcggtttttaacggaccgtttaaccggttaaccccgtttgtttaacggtaaccgttacgggtaccgggggtacccgtaaacgggggttaacccccg

SEQ ID NO: 392194 - DNA, 596 bp, Homo sapiens
  misc_feature: GZ8MTXP02JZ3GZ.39.81.H04.1.454.CMB.2.raw
  modified_base (285)..(285): a, c, t, g, unknown or other
  modified_base (331)..(331): a, c, t, g, unknown or other
  modified_base (354)..(354): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttcgtggttacacctttacaacttatggtatctaggttgggtgcgacncggcccctggacaagggcttggagtggagtgggatggatcgagctnttaacgatggtcaacacaaactntgaccacagacctcgagggacagcgtcaaccagtcgacacagaccacgataccacgacgaccaccggacctacgagtacggacctggacgtacgccgtaggacgtatccggtaggaaccgtaaccgaccggtaccgtgttaacgtaccgtggtcgacgaggaggtacgtaacggggtaaattagttcgacgttcgtacccttgttacgacgtacggtacggccgtaacgggtacccttacgg

SEQ ID NO: 392195 - DNA, 659 bp, Homo sapiens
  misc_feature: GZ8MTXP02I8YXQ.39.81.H04.1.454.CMB.2.raw
  modified_base (282)..(282): a, c, t, g, unknown or other
  modified_base (288)..(288): a, c, t, g, unknown or other
  modified_base (552)..(552): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggtcttcgtgttaacctacctttaccaactatggtatctaggttgggngcgacncggcccgtggacgaggtctggagtggagtggagtggatcgagtcgcttaacaagttcggtacaaccaaacaaactatgacccaacgaacgtaacccgtcgaagggcaacggcgtaccaaccgtagtaccgaaccaacaacgaaccaaacaccgtacccaacgacgaccgtaaccggacctacgacgtaccggacctaggacggaccgacgtagaacgtacgtacgtacggaaccgacgtaccgggtccgttaagtacgttacgngtacggacgaggaacgtaggggtacgggtaaattacgtttacgaccgttaccgttaccttcgttacgaaccgttacggaccgggtaccgtaacggggtacccttcgg

SEQ ID NO: 392196 - DNA, 701 bp, Homo sapiens
  misc_feature: GZ8MTXP02IHD69.39.81.H04.1.454.CMB.2.raw
  modified_base (226)..(226): a, c, t, g, unknown or other
  modified_base (244)..(244): a, c, t, g, unknown or other
  modified_base (268)..(268): a, c, t, g, unknown or other
tcagtcgcactagtcacgaccggtgctcgatttagtagtgtagattcgcggggacccaaaaaccacacccctccttgggagaatcccctagatcacaggtcctcaccatggactggacctggagcatccttttcttggtggcagcaacaacaggtgcccactcccaggttcagctggtacagtctggagctgagatgacgaagccgtggggcctcagtgaaggtcncctgcaagcttctgtacncctttacaatatgtatcagttggngcgacacggcccctggacgaggcttggagtggatgggatgggatcgagcgtacttaacgaagttcggtacaacaactaaacgtatacgaccaaccgaaccgaaaccctaccgaaggggacaaggacgtaccaacctataccgaaacccaccagaacctaacaactccaacgacgaccgaccggacccttaacacgttacggacccgtagggaacggacgtaccgttagaacggtactcgtacggaccggaccgtaccgggtaccgttagttacgtttaaccgggtggtacggacggtagggtaacggtaacgggttaaacgggtttaaactttacggtttacggttaccgtttaccggtttaccttacggtttaacggtaccggttacgggtaccggggtaccgggtacccggtaaccggttacccggtaccg

SEQ ID NO: 392197 - DNA, 625 bp, Homo sapiens
  misc_feature: GZ8MTXP02FZ6U3.39.81.H04.1.454.CMB.2.raw
  modified_base (195)..(195): a, c, t, g, unknown or other
  modified_base (439)..(439): a, c, t, g, unknown or other
tcagtcgcactagtcacgaccggtgctcgatttagtagtgtagattcgcggggactgatcaggactcctcagttcaccttctcacaatgagggtccctgctcagctcctgggactcctgctgctctggctcccagataccagatgtgacatccagatgacccagtctccatcctccctgtctgcatctgtagganacagagtcaccatcacttggccgggcgagtcgagggctagttaggctattattagcctggtatcaacagccgacccggggaagttccaggactcctgatctatgatgacatacctaaagtttacggaaccgtacggggtcccagttcctcgtattcagggtgggcggggttggggtcgtggggaacctagtattttccacgtcctaccacctatcgaagcacggtcctgcttcgactagaagtntcggctcgtaactaacctttagtttaactacggtaataaaacgttagtacggtaacgtacggttccgggttaccccggttacgggttacccggttaccgggacccgtaaacggggacccgtaaagggttacggaaaacttaaccgaaaacgtaccgttagggacgtaccgtcgaccctacttaccg

SEQ ID NO: 392198 - DNA, 684 bp, Homo sapiens
  misc_feature: GZ8MTXP02IIL4D.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctgagtgaaggtctctgacaagtcttcgtagttactaccttacaatagtggtatgtaggttggtgcgacgacggcccgtaggaacgaaggtcttaggaggtggagtgggagtggatcgagcgtacttaacgaagttggtaacaactaaactaaaactagtacgaacccctaaaccgaaaccgtaacccgtaccggaaacgggaccaaggaccgtaccaaaccgacgtaaccgaaaccccaacaaacgaacccaacctaacgaacccgacgaacgaccgaacccgtacctaacgacgtacggacgtaggacgacgaccgtagacgtagtacgtacgacgacgacgtacgtacgttagttacgtgtagacggtagaggtaaggtaacggtaaagttacgtttacgtacgttaccgttaccgttaacgttacgttacgtacggtaccgggtaccggtaaccggtaccggtaccgg

SEQ ID NO: 392199 - DNA, 626 bp, Homo sapiens
  misc_feature: GZ8MTXP02IJQXB.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacagcccctggacaaggcttgagtggatgggatggatcgagcgtacttaacagtggtaccaacgaaactaaaactatgacccaacaacgaaccctccgaggcaagcgtacacatcgaccacagacacactaccacgacgaccgacgacctaacgacgtacggaccctagaacggacgccgtagacgtatacgtacggaaccgacgaccgggtacgttagttaacgttacgtcggtacggacggtaggaacggtaggtaacgggtaaaattacgtttacggacgttacgggttacccttcgtttacgaacgttacggtacgggggtaccgtacggggtaacccgtttcggg

SEQ ID NO: 392200 - DNA, 643 bp, Homo sapiens
  misc_feature: GZ8MTXP02GSK3V.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaaggcttggagtggatgggatggatcagcgtcttacaatggtacaacaacaaactatcgaccaacgaacgaaccctccgaaggggaccaaggacgtccaaaccatacgaacccaacgaagaccacactacccaacgaacgaccgaccggaccctaacgacgtacgggaacccgtggaacggacgccgtaggacggactcgtacggaccgaaccgaccgggtcgttagttaacgttaccgtagtagacggtaaggacggtagtaacgggggtaaattacgtttacgaccgttacggttacccttcgtttacgaccgttacggtacggggaccgtaacgggtaacccgttcgg

SEQ ID NO: 392201 - DNA, 751 bp, Homo sapiens
  misc_feature: GZ8MTXP02IZCOV.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttcgtggttactacctttacaactatggtatcagttgggtgacgacacggcccctggacaagggcttggagtggatgggatggatcgagcgtacttacgaagtggtacaacaacaaactatcgacccaacgacgaacctccgaggacaagcgtaccaaccgagtaccgaaccaacaacgaacaaacctacacccaaacgacgaccgaacccggttacctaaccgaacgttacggaacccgttagggaacgggtaaccgacccgttaggaaaacggtcttaccggtaacgggaaaccccggaaccggttaacccggggtacccggtttaggttaaacgtttacccggtttagggtaccggtaccgggtaaaggacgggttaaaacggggtaccgggggttaaaaaattttggtttttaaccggaaccgtttacgggttaaccccctttaaggtttacgtaaaccgttaaccgggtcggggtaacccccggtaaacgggtaccccgtttaaccgggg

SEQ ID NO: 392202 - DNA, 670 bp, Homo sapiens
  misc_feature: GZ8MTXP02JPWW0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacgaaggcttggagtggagtgggatggatcagcgcttacaagtggtacaacaacaaactatgacccacacgaaccctccgaagggccagacgtaccaaccatcgaaccacaacgaccaacacacccgaacgacgaccaaccgggtacctaaccgagtacggaacccgaggaacgggtaacgcccgtaggaacggtactacgtacggaaccgaacccgtaaccggtcccggttacgttaacgttaccgtaggtcggaccggtaaggaaggtacggttaacgggggtaaaatttacggttttacggaccgtttaccggttacccgttcgtttacggaaccgttacgggtacgggacccgtaacggggtaacccgtttccggg

SEQ ID NO: 392203 - DNA, 758 bp, Homo sapiens
  misc_feature: GZ8MTXP02FSOA4.39.81.H04.1.454.CMB.2.raw
  modified_base (526)..(526): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctcgcccgtcaccgttggacacgccggcctccatcctcctgctaggtctagtacaaacgtcctacgtaatactagttagaagtaacggaaaacctaccttacgttagtaagtttggttacagcgaaggacggccaaggacctaaactccgtaccgaaggccgtaacctttaaaagttttaagttaacggtttaccgtaaacccggggtaccttcgggttaccggggtaccccaaggtaacgacgtaccgttaccgaaggccggtacgtagggtcggggttacacggggcctaacggtagtaacttcaaactacgtaagaaaactcgaacggtaggaagggggtaggacggngtaggggtaggttaagtttcggggtttaggggtttactttacggtagtacgtagtacgaacgtaaaacgggaacctaaccgtaccgtaccgggtaccctttaccggtacgttaaccggtttacgggaacccggtaacgggaaaccgaacggtaccggtaaggaaacgaacgttaaaccgaaaaccggttaagtcggtacgtaccgtacgacctaaccgtacttacgtttccg

SEQ ID NO: 392204 - DNA, 580 bp, Homo sapiens
  misc_feature: GZ8MTXP02JERU3.39.81.H04.1.454.CMB.2.raw
  modified_base (274)..(274): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatgtatcagttggtncgacacggcccctggacaagggcttgagtggatggggatggatcgagcgacttacaagtggtacacacaaactatgaccacacgacctccgagggcagagtcaccatcgaccacagacacatccacgagcacggacctaacagtacgaccgtagacggacgccgtagagtactcgtacgaaccgtacgaacgggtccgttagtattacgtgtcgacgtagagacggtaggggtaaattcgtttacggactacggttaacccttcgtttacgacgtaccgtacgggggaccctacggggtaaccccg

SEQ ID NO: 392205 - DNA, 618 bp, Homo sapiens
  misc_feature: GZ8MTXP02FF3PL.39.81.H04.1.454.CMB.2.raw
  modified_base (371)..(371): a, c, t, g, unknown or other
  modified_base (385)..(385): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttaacaatggtcaacacaaactatgccacagaacctccgaggggcaagngtcacatcgaccanacgaacacactacccacgacgcgaaccggccctaacatacgggaccctggacgggacgcctaggagtatcgtacggaaccgaccgaaccgggtcccgtagttaacttacgtggtacgacggaggaggagttaaccgggggtaaaatttagttttacggaacgttcggttacccttaacgtttacggaaccgttacgggtcgggggacccgtaacgggggtaaccccgttcggg

SEQ ID NO: 392206 - DNA, 583 bp, Homo sapiens
  misc_feature: GZ8MTXP02I0MUR.39.81.H04.1.454.CMB.2.raw
  modified_base (249)..(249): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacnccttactgaattggttcagcagagccaggccaatctcaaggcgacctaatttataaggttctaacccgggactcgtcggggtcccagacagactcagcggcagtgggtcagggcacgtgaattccaacactaagaaaactcagcgaggggtgagcgtggaaggtagtgggtttagggttattacgagtccagtgacgaaggtaaccacgtacgtcgcctaccggtactaacggtttcgaccgtaacggggacctaaaggtccgtaggaacgtacgtaaaccgtaaacgtaaccgttggacggtacgtacggacctaacccgagttaccgtttcg

SEQ ID NO: 392207 - DNA, 696 bp, Homo sapiens
  misc_feature: GZ8MTXP02GSPPJ.39.81.H04.1.454.CMB.2.raw
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacacctttacaactatggtatcagttgggtncgacaggcccctggacaagggcttgagtggatggatggatcgagcgcttaacgaatggtcaacaacgaaactatgacccacagtaacctccgagggccaagcgtccaaccgatacgaaccacgtaagaaccactactacccgaacgaacgaccgaaccgggacccttaacgaagttacgggaacccgttaggaaacgggacgtacccgtaggaacgtacgttctacgggaaccgaaaacccgtccggggtacccgttagtaacgtttaaccgggtaggtacggaacggtaacgaaacgggtacgggttaaacgggtaaagttttacggtttacggaccgtttaccggttaacccgtttaacggtttaacgtaaccggttaccgggtaccggggaacccgttaaccggggtaacccgttcgg

SEQ ID NO: 392208 - DNA, 653 bp, Homo sapiens
  misc_feature: GZ8MTXP02HXKCZ.39.81.H04.1.454.CMB.2.raw
  modified_base (269)..(269): a, c, t, g, unknown or other
  modified_base (417)..(417): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcagcttctgttacaccttacaactatgtatcagttgggtncgacgacggcccctggacaagggtcttggagtggatgtgatggatcgagccgtactttaacaagttcggtaccaacgtaaccaaaacttatacgacaaccaacgaaaccctccgaaggggcaggacgtaccaaccagtacgaacccanacgaacctaacgactacccgaacgacgaccgtaaccggacccttaacgagtaccgggaaccgaggaacggacgccctaggagactcgtacggaacgaccgacggtaccgttaggttaacttacgtggtcggacggaaggaacggtaaggtacggggttaaaactttgtttacgacgtttacggtaaccctttgtttacggtaccgtacggtaccggggaccgtaacgggtaacccg

SEQ ID NO: 392209 - DNA, 630 bp, Homo sapiens
  misc_feature: GZ8MTXP02ITC7K.39.81.H04.1.454.CMB.2.raw
  modified_base (372)..(372): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacaccctttaccaactatggtatcgagttgggtgcgacaggcccctggacaagggcttgagtggatgggatggatcgagcgcttacaatggtacacaacaaactatgaccacagaacctcgagggcagngtcaccatcgaaccagagacacactccacgagccacgcctacgatacggacctagaggacgccgtagagatcgtacggaccgaacgtaccgggccgttagttaacgttaccgtaggtggaccgtaggaacggtacgggtaacgggggtaaaatttacggttttacggtaccgttacggtttaaccccgttcgttttaccggtaaccgtttaacgggtccgggggtacccgtaacgggggtaacccccgtttaccgggg

SEQ ID NO: 392210 - DNA, 664 bp, Homo sapiens
  misc_feature: GZ8MTXP02GKT0E.39.81.H04.1.454.CMB.2.raw
  modified_base (370)..(370): a, c, t, g, unknown or other
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcaacgacaaactatagccacacgaacctcgaggcagngtcaccatacgaccaacagaccacactacccacgaagcctaaccggccctaacagtcggaaccctaggacgggacgcccgttaggaacggactaccgtagggacccgaaccggaccgggtacccggttgttaaacgtttaccgtaggttacggaacctaaaacggaggtaaggttaaccgggggtaaaatttacgtttttacggaaccgttaccggtttaaccccgttaacgttttacggaaccgtttacggtccgggggtaacccctacgggggtaaaccccgtttaccgggg

SEQ ID NO: 392211 - DNA, 628 bp, Homo sapiens
  misc_feature: GZ8MTXP02HWC72.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttacaactatggtatcagttgggtgcgacaggcccctggacaagggcttgaggtggagtgggatggatcgagcgacttacaagtggtacaacaacaaaactatcgaccacaacgaaccctccgaggacagcgtacaccatcgaccacagaccacactaccacgagccgaacggaccctaacgagtcggaccctggaacgggacgccgtaggaagtactacgtacgggacccgaacgaccgggtccggttagttaactttacgtggtacgacggaaggaggtaggtaacggggtaaatttacggttttacgacgtttcggttacccgtttgtttacggtaccttacgggtcggggaccgtacggggtaacccgttcgg

SEQ ID NO: 392212 - DNA, 667 bp, Homo sapiens
  misc_feature: GZ8MTXP02HM8L6.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggagtgggatggatcgagcgtacgttacaagttcggtacaacgaaacctaaacgtatacgacccacgaacgaacccctcgagggaccaggacgtaccaaccgataccgaacccacgaaacgaccacaactacccgaacgacgaccgaaccgggccctaacgacgtacggaaccgtagggaacggacgccgtaaggacgtacgtacgtacgggaaccgaccgaccgggtccgtagttacttagtcggtagacggaggtaaggtaggtaaaccggggttaaattgttttacggaccgtttacggttaccctttcgttacgtaccgttacggggtaccggggtaccgtaacggggtaacccgttcgg

SEQ ID NO: 392213 - DNA, 625 bp, Homo sapiens
  misc_feature: GZ8MTXP02FOROG.39.81.H04.1.454.CMB.2.raw
  modified_base (251)..(251): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgataggaaacnctacttgaattggttcagcagagcaggccaatcctacaaggcactaatttataaggttcaaccggctcgtcggggtacccagacagacttcgagcggcaggtcgggtcagggcacgtagaaactttaccgaactaaccgtagaaaaacttccgaaagaccgaagggggttacgggaagggtacgtagggtaaggtaaggtttgggtttagggggtttaatttaccgtaggtacctagttagaacgtaaaagggaaaccaacgtaacgtcgggtacccttaccgtacgttaacgtttcggaccgtaacggggaccgaagtcgtaggaagacgtaacgaaacgtaacgtgtcgactacgacgtacctatcgttacg

SEQ ID NO: 392214 - DNA, 652 bp, Homo sapiens
  misc_feature: GZ8MTXP02JVS12.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcgaggttgggtgcgacacggcccctggaacgaagggcttggagtggagtggatggatcgaggcgtcttaacgaagttcggtacaacaaactaaactagtcgacccaacaagtaacccaccgaagggcagtacgtaccaccagtcgaaccactaaacgaccaacactacccgaacgacgccaaccgggaccctaacgagtacggaacctgggaacgggaacgcccgtaggacgtacgttcgacggaccgaacgccgggtcgtagttacttacgtggtgacgtaacggaaggtaggtaaacggggtaaatttagtttacgaacgttcggttaacccttgttacgaaccgtttacggccggggtaccctaacgggggtaacccctcggg

SEQ ID NO: 392215 - DNA, 550 bp, Homo sapiens
  misc_feature: GZ8MTXP02GNAQY.39.81.H04.1.454.CMB.2.raw
  modified_base (505)..(505): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcaccctggacagccggcctcatctcctgcaggtctagtacaaagcctgtatacattgataggaaacacctacttgaattggttcagcagagccaggccaatcctaccaagggcctacctaatttataaggtttcaaccgggctcgtggggtcccagacagtatccgagcgatagtggtacaggcacgtgaattcaacactagaaaactcagcgagggtggaggcgtaggaggtagttgggtttagggtttattacgtgactagtgacgaaggaacacgacgtcggacctccgtactcgtttacggcgaggtacagcgtagganactacgaaacgtacgtaggtgactacgtactatctcgtacttacg

SEQ ID NO: 392216 - DNA, 720 bp, Homo sapiens
  misc_feature: GZ8MTXP02HLWJT.39.81.H04.1.454.CMB.2.raw
  modified_base (215)..(215): a, c, t, g, unknown or other
  modified_base (239)..(239): a, c, t, g, unknown or other
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctnagtgaaggtctcctgcaggtcttntgtactaccttacactatgtatcgtagttggngcgacacggccctggacgaggtcttgagtggagtggagtggatcgaggcgtacttaacgaagttcggtacaaacaaactaaaactgtacgacccaaccgaaccgtaacccgtacggaaggggacctaaggaccgtaccaaccgtagtaccgaacccaacgaacgaacccaacctaacacccgaacgacgaccgaacccggtacctaacgaggttacggacccgtagggaacggtaccgaccgttaggaaaccgttacgtaccggtaacgggaacccgtaaccggtacccggggttaccgttaagggtttaaccttacgggtgggtaacggaccggtaagggaaacggttacggtaaacggggttaaatttacggtttacggaccgtttacgttacccttggttacggtaaccgttacgggtaccggaccgtaacgggtaccccgttcgg

SEQ ID NO: 392217 - DNA, 665 bp, Homo sapiens
  misc_feature: GZ8MTXP02H3IFC.39.81.H04.1.454.CMB.2.raw
  modified_base (356)..(356): a, c, t, g, unknown or other
  modified_base (393)..(393): a, c, t, g, unknown or other
  modified_base (414)..(414): a, c, t, g, unknown or other
  modified_base (471)..(471): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctaggttacacctttacaacttatggtatcagttgggtgcgacacggcccctgggacaagggcttggagtggagtgggtatggatcgagcgacttaacatcggtacacaaacgaaactntacgacctacgaacgaaccctccgaaggggctaacgngtaccaacatacgaacccaanacgaaccaacactaccgaacgacgaccgaaccggacctaacgacgtacggaacccgnggaaacggcgtaccgtagacgtagttaccgaggaccgtaacgacccgggtcgttaacgtacttaccggtagtacggaaccggagtaacggtaggtaaccggggtaaaaatttcgtttacgaccgtttcggttaaccctttcgtttacggaaccgtttacgggacggggtacccggtacggtaaaccccgtcggg

SEQ ID NO: 392218 - DNA, 657 bp, Homo sapiens
  misc_feature: GZ8MTXP02J2HNA.39.81.H04.1.454.CMB.2.raw
  modified_base (386)..(386): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaaccaacttatggtatcgtagtggtgcgacacggcccctggacaagggtcttgagtggagtgggatggatcgagcgcttacgaatggtacacaacaaactatcgacacacgacctcgagggcagatacacctancgaccagacgacacactacccgacgacgaccacggccaacgagtacgggaccctggaacggacgcctaggacgtaactccgtaggaacccgaccggtaaccgggtccccgttaggttaaccgttaaccgttgggtacgtacccgggaaggtaacggaggttaaacccgggggtaaaatttacgtttaacggtacccgtttaccgggttaacccctttacgtttacgtaccggttaccggtaccgggggtacccgtaaccggggtacccccg

SEQ ID NO: 392219 - DNA, 643 bp, Homo sapiens
  misc_feature: GZ8MTXP02ICPL8.39.81.H04.1.454.CMB.2.raw
  modified_base (549)..(549): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctccgtgcaaggtctttcgtggttacctacctttacaacttagtggtatcgtaggttgggtgacgacgtacggccccgtaggaaccgaggcttaggagtggagtgggatggatcgagcgtataacaagtcggtacaacaactaaatgacgacccaacgtaacgaaccctacgaggacaaggcgtacaaccgataccgaaccacgaacaccaactacacccgaacgacgacccgaaccgacctaacgagtacggacctagggacgacgtaccgtagacgtacgtacgacggaccgtacgaccgggtacgtagttacgttacggnggtacgagacgtaggtaacggtaagttaacgttacgttacgacgttacgttaccgttaagttacgaacgtacggacggtaccgaccgtacgtcg

SEQ ID NO: 392220 - DNA, 592 bp, Homo sapiens
  misc_feature: GZ8MTXP02GOSMC.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctgaggcctcagtgaaggtctcctgcaaggcttctggttacacctttacaactatggtatctagtggtgcgacaggcccctggacagggctgagtggatgggatggatcagcgcttacaatggtacacaacaaactatgacaacagaaccctacgagggcaggacgtaccaccagtacgaccacgacgaaccacgactccgaacgacgccaacggccctaacgacgtacggacctagggaggacgcctaggagatcgacgaccgacgacggtccgtagtacttacgtgtagacggagacggtacgtacggggtaaatttagtttcggacttacggttaacccgttcgtttaggaccgttacggtccggggtacgtaccgggtaacccgg

SEQ ID NO: 392221 - DNA, 561 bp, Homo sapiens
  misc_feature: GZ8MTXP02GS1DZ.39.81.H04.1.454.CMB.2.raw
  modified_base (418)..(418): a, c, t, g, unknown or other
  modified_base (466)..(466): a, c, t, g, unknown or other
tcagtcgcactagtcacgaccggtgctcgatttagtagtgtagattcgcggggacccaaaaaccacacccctccttgagagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgcttacaatggtcaacacaaactatgaccacagaacctccgaggggctagagtcaccgatgaccacagacacatccacgagcacggcctacatgaccngaggagcctagacgatcgtagaccgacgacggccgttagtatactgtncgagagagtacggggaaactttagtttacgacgttcggtaacccttacgtttacggtacgttacggttacggggacccgacggggttaaaccccg

SEQ ID NO: 392222 - DNA, 634 bp, Homo sapiens
  misc_feature: GZ8MTXP02JA0KE.39.81.H04.1.454.CMB.2.raw
  modified_base (281)..(281): a, c, t, g, unknown or other
  modified_base (555)..(555): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacaccttacaactatggtatcgtagttgggtgcgacncggcccctggacgaagggcttggagtggagtgggagtggatcgagcgtacttacaagtggtacaaccgaaactaaactagtacgacccaacgaacgaaccctccggaagggacaacgacgtaccaaccaataccgaacccaacgaaacgaacctaaaccgtacacccaaacggacgacccgaacccggtacctaaccgaacgttccggaaccgtaggacgggtacaccggttagacgtactcgacggacccgacgccggtaccgttgtattcgngtgacgagagagtaacgggtaaattgtttacgacgttcgtaccttgtacgacgtacggtcggaccgtacgacccgttcg

SEQ ID NO: 392223 - DNA, 635 bp, Homo sapiens
  misc_feature: GZ8MTXP02H73YU.39.81.H04.1.454.CMB.2.raw
  modified_base (415)..(415): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttactacctttacaactatggtatcgagttgggtgcgacacggccctggacaaggcttggaggtggagtgggatggatcgagcgtacttacaagtcggtacaacaaactaaactatcgccaacacgaaccctcgaggacagctaccaacagtacgaaccaacagaaccaactanacccaacgacgacccgaccgaccctaagacgtacggaacctggaacggcgccgtaggaacgtacttacgacggaaccgaaccggaccgggttccgttagttaacgttacgtggtacggacggaaggaacggtaacgggttacggggtaaaatttcggtttacgaacgtttcgtaaccctttgttacgacgttacggcgggaccgtaacggtacccgtcgg

SEQ ID NO: 392224 - DNA, 726 bp, Homo sapiens
  misc_feature: GZ8MTXP02GW53B.39.81.H04.1.454.CMB.2.raw
  modified_base (579)..(579): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtgggcctcagtgaaggtctcctgcaaggtcttcgtggttacacctttaccaactatggtatcgtaggttgggtgcgacacggcccctggacaaggcttgagtggagtgggatggatcgagcgtacttaacagtcggtacaacaaacgaaaactagtacgacccaacgaacgtaacctccggaaggggccaaggtacgtacccaaaccgtagtaccgaaccaaacgaaacgaaacccaacgaacctacccgaaaccgaacgacccgaacccgggtaccctaacgaacgtaccgggtaaccagggaacggtacgccgtaaggacgtacgtcgtaacgggaacgaaccggcggcccgtttaagtactttaacggnggtacggaacggaaggtaacggtaaacgggttaaacgggttaaaattttacggtttacgtaacccggtttacgttacccgtttaacgtttaacggtaaccggttaccggggtaccggggaaccgtaaacccggggtacccgtaccgg

SEQ ID NO: 392225 - DNA, 645 bp, Homo sapiens
  misc_feature: GZ8MTXP02IPH61.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttggtgcgacaggcccctggacaagggcttgagtggatgggatggatcgagcgacttacaagtggtacacaacaaactatgcccacacgaaccctcgaggacagacgtcaccagtcgaccaacagaccacactacccacgacgaccgacggacctacgagtcggaacctggacggacgcccgtagaggtactcgtacggaaccgaccgtaccgggccgttagttaacttaccgtggtacgacggaacggaaggtaacggtacgggggtaaaactttaggttttacgaaccggtttacgggtttaaccccttaacggtttaccggtaacgtttaccgggtacggggacccgtaacgggggtaaccccctttacgggg

SEQ ID NO: 392226 - DNA, 672 bp, Homo sapiens
  misc_feature: GZ8MTXP02F8Y6R.39.81.H04.1.454.CMB.2.raw
  modified_base (561)..(561): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgagttgggtgcgacgacggcccctggacgaagggtcttggagttaggagtgggatggactcgagcggtacttaacaaagttcggtacaactaactaaaactagtagaccaacgaacgaacccgtaccgagggaccaggacgtccaaccagtacgaaccaacagtaacccaacacgtacccaaggacaccgacccgaaccgtacctaagtacggacctaaggacggaacgtcccgtagacgtacgtacgtacggacgacccgtacgggtccgttagttacgttactaggtaccggngtaaggacggtaggttacggggtaaaatttacgtttacgaaccgtttccgggttaccttcgtttacgaacgtttaccggacggggtaccgaacggggtaccctttaccggg

SEQ ID NO: 392227 - DNA, 655 bp, Homo sapiens
  misc_feature: GZ8MTXP02GLVNO.39.81.H04.1.454.CMB.2.raw
  modified_base (635)..(635): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggcttctggttactacctttaccaactatggtatctaggttgggtgcgacacggcccctgggaacaaggcttgaggtggagtgggatggatcgaggcgtacttaacaagttcggtacaaacgtaaactaaactagtacgacccaaacgaacgaaccctaccggaaggggacaaggtacgtaccaacctaagtaccgaacccgaaacacggaaacctaacgactaacccgaacggaacgaccgaaccgggaccctaacgacgtacggaccgtaggacggaaccgtccgtaagacgtaacgttccgacggaaccgaccgtacggtccgttagtactacgtgtgacgtagacgtaggtacgggtaaaattcgttacgtacgtcgttacctgttacgacgtacgngggacgacggtacccgtcgg

SEQ ID NO: 392228 - DNA, 646 bp, Homo sapiens
  misc_feature: GZ8MTXP02G79ON.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttacaactatggtatcagttggtgcgacacggcccctggacgaaggcttggagtggagtgggatggatcgagcgtacttaacaagtcggtacaacgaactaaactatagacccaacgagaaccctccgaaggggccaagacgtaccaacagtaccgaaccaacgacgaaccaacactacccgacgacgaccgacgaccgtacacgtacggacctagggaacggacgtaccgtaggacgtactacgtaggaaccgtaccgaccgggtaccgtagttaacttaccggtgtacggacgtaaggacggtaaggtacgggtaaattagtttacgacgttaccggttaccttaacgtttagaccgttacggtcgggtacccgtaacgggtacccttacggg

SEQ ID NO: 392229 - DNA, 845 bp, Homo sapiens
  misc_feature: GZ8MTXP02FIR53.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtgggcctcagtgaaggtctcctgcaaggcttgtgttacacctttaccaattatggtatcgtaggttggtgccgacgacggtcccctagggaacgaagggtcttaggaggtggagtggggatgggactcgaggccgtactttaacgaaacgttcggtaccaaaccgtaaacctaaaacgttactacggaccccctaaaaccgtaaccggaaaaccccttacccggaaaggggtacccaaagggtaccgttacccaaaaccgtaacgtaccgaaacccaacgaaacgaaaccctaaaccgtaactaaccccggaacggaacgacccgtaaaacccgggtcccctaaacgaacggttaccgggaccttaaacggggacggtacggtacccgtaagggacgtaccgttacgtaacgggaaacccgacccggtacccggggtaccgtttaaggttacgttaccggttaggttacgggaccggtaaaggtaaccggggtaacggtttaaacgggggtaaaatttttacggtttacgtaccgggttaacccggttttaaacccccgtttggtttaaaccggtaacggttacccgggggttaccgggggtaaacccgtaacccgggggtacccgttttaacccggg

SEQ ID NO: 392230 - DNA, 630 bp, Homo sapiens
  misc_feature: GZ8MTXP02F5357.39.81.H04.1.454.CMB.2.raw
  modified_base (266)..(266): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaggcttctgttacaccttacatatgtatcagttggngcgacacggcccctaggacgaagggtcttggagtggagtgggatggatcgagcgtacttaacgaagtcggtacaacaactaaactagtcgaccaacacgaaccctcgaaggggccaagcgtccaaccgataccgaaccaacgaacgactaacactacccgacgaacgacccgaccggtaccctaacgacgtacgggaccctaggacggacgcccgtaggacgacttcgacgaccgaccgaccgggtccgttagttacgttacgtggtacgacggagtaggacggttacgggtaaaatttcggtttacgacgttcggttacccttgtttacgacgtacggtcgggaccgtacgggtacccttcgg

SEQ ID NO: 392231 - DNA, 555 bp, Homo sapiens
  misc_feature: GZ8MTXP02FS1BQ.39.81.H04.1.454.CMB.2.raw
  modified_base (343)..(343): a, c, t, g, unknown or other
  modified_base (364)..(364): a, c, t, g, unknown or other
  modified_base (379)..(379): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgccacagaacctcaggcagngtcaccatcgaccanagacacatcccacgagcacgccacatggacctagaggagcctgagatcgtagacgacgacggccgtgtacttacgtgtgacgagagagtacgggggtaaaattagttttacgaacgttcggttaacccttcgtttacggacttacggtcggggacccaacggggtaacccttcggg

SEQ ID NO: 392232 - DNA, 574 bp, Homo sapiens
  misc_feature: GZ8MTXP02J45E2.39.81.H04.1.454.CMB.2.raw
  modified_base (344)..(344): a, c, t, g, unknown or other
  modified_base (350)..(350): a, c, t, g, unknown or other
  modified_base (363)..(363): a, c, t, g, unknown or other
  modified_base (372)..(372): a, c, t, g, unknown or other
  modified_base (374)..(374): a, c, t, g, unknown or other
tcagtcgcactagtcacgaccggtgctcgatttagtagtgtagattcgcgggccccaaaaaccacaccctccttgggagaatccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaaggcttgagtggagtgggagtggatcagcgacttcgaatagtcgtccacaacaactncgcacncaactcacggcgngacgtaccncncacacacacacacactcacacgacacgaccgtcacacgtacgacgtagacggacgcgtagagacgtcgacggacgacggaccggtaccggttgttacgttcgtagttcggaggtacgtaggtaacggtaacgttaacgttacggttaacttacgtttcgtaccgttacgttaccgttacgtaccgttacgtaccggtcgg

SEQ ID NO: 392233 - DNA, 656 bp, Homo sapiens
  misc_feature: GZ8MTXP02FJGNJ.39.81.H04.1.454.CMB.2.raw
  modified_base (346)..(346): a, c, t, g, unknown or other
  modified_base (403)..(403): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcaggcgcttacaatggtacacacaaactntcgccacacgacctcgagggccagcgtcaccatacgaccacagacacatcccacganccacggccctacacgtcgggaccctaggacgggacgcccgtggaacgtacgtccgtaggacccgaaccgtacccggggtcccgtttagttaacgtttaccgtaggttcggaccggtaaggaacggtaaggttaaccgggggtaaaatttacgtttttacggaaaccgtttcgggttaaccccctttaacgtttcggtaacccgtttacgggttacgggggaccccgtaaacgggggtacccccctttacgggg

SEQ ID NO: 392234 - DNA, 560 bp, Homo sapiens
  misc_feature: GZ8MTXP02F297A.39.81.H04.1.454.CMB.2.raw
  modified_base (262)..(262): a, c, t, g, unknown or other
  modified_base (299)..(299): a, c, t, g, unknown or other
  modified_base (327)..(327): a, c, t, g, unknown or other
  modified_base (534)..(534): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccgctccatctcctgcaggtctagtcaaagcctcgtatacattgatgaacactatgattggttcagcngagcaggcaatctcagcactattataagttcaacggntctgggtccagacagattccgagcgganacggtggtcagggcactgaattcacgtactagaaatacagacgaggggtaggaggcgtaggaggtagttagggtttaggggtttattacgttgacgtagtagacgaaaggaccgaacaaccgttcggacccttccgggttaactacgttttacggaccgtaacggggaaccgaaagccgtacgggagaagtacgaaaacgtacgtgnggtcacgtcacgtactcgtacgttcc

SEQ ID NO: 392235 - DNA, 683 bp, Homo sapiens
  misc_feature: GZ8MTXP02IBRFV.39.81.H04.1.454.CMB.2.raw
  modified_base (247)..(247): a, c, t, g, unknown or other
  modified_base (254)..(254): a, c, t, g, unknown or other
  modified_base (620)..(620): a, c, t, g, unknown or other
tcagtcgcactagtcacgaccggtgctcgatttagtagtgtagattcgcggggactgatcaggactcctcagttcaccttctcacaatgaggctccctgctcagctccgtggggctgctaatgctctgggtcccaggatccagtggggatgttgtgatgactcagtctccagtcctccctcgcccgtcacccttggacacgccgcctcatctcctgcaggtctagtacaagtcctgtatacattganacgaacnctatagaattgttcagcagacgcacgacaactccgtacgaaggccgtaaccttaagttttaacgttaacggtttacccggtaaacccgggttcgtaccggtacggggtaccccaaggtaacctaaggttaacgtttaacggccgggtacgtaaggggtttcggggactacgggtacctaacgttacggtaaactttccgaaactaaacgttaacgaaaacttcgaaggacgggtaggggtaggaggtgtagggaggttagttcggggtttagggtttactacggtgtacgtagttacggacgtaaacggaacacgtacgtacggtacccgtcgttaacgttacgtttacggacggtacgggaacgngtacgtacggaactacgacgtaaaacgcgttaacggagcgtacgaccgttactacgttactcg

SEQ ID NO: 392236 - DNA, 641 bp, Homo sapiens
  misc_feature: GZ8MTXP02H08KY.39.81.H04.1.454.CMB.2.raw
  modified_base (521)..(521): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttacaacttatggtatcgaggttgggtgcgacgacggcccctggaaccgaagggcttaggagtggagtgggagtggatcgagcgtattaacaagtcggtacaacaaactaaactatgaccaacaacgaacctccgagggacagcgtaccacatacgaaccagtaacaacacacacccgaagcgaccacgactaacgagtacgaccgtagaacgacgtacgtagacgtataccgaggaacccgacgaccggtcgttagtaactttacggngtacgacggtaaggtaaggtaaggtaaacggttaaatttacgtttacgaccgtttaccgttaccttaaggttaacggtaacggttacgggtaccggtaccggtaaccgggtacccgtcgg

SEQ ID NO: 392237 - DNA, 600 bp, Homo sapiens
  misc_feature: GZ8MTXP02HNE1U.39.81.H04.1.454.CMB.2.raw
  modified_base (213)..(213): a, c, t, g, unknown or other
  modified_base (275)..(275): a, c, t, g, unknown or other
  modified_base (280)..(280): a, c, t, g, unknown or other
  modified_base (318)..(318): a, c, t, g, unknown or other
  modified_base (331)..(331): a, c, t, g, unknown or other
  modified_base (392)..(392): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctnagtgaaggtctcctgcaaggcttctggttactacctttaccaatatggtatcaggttgggtncgacnggcccctggaaccaaggcttgagtggagtgggatggangagctcgttaaanagtcgacaacaaactaaactatacgaccaactaacgaaccacggagagtaagcaccaacanacaacaacaacaacaacaacaccacgacgacgacgacgtacacgacggacgtacgagacgacgtagagagtacgacgaacgacgaccggtacgtaacgttacgttacgtagaggagagaggaaggtaaacggtaagttaacgttacgtacgtacgttaccgttaacgttacgtacgtacggtacggtaccggaaccggtaaccgtacg

SEQ ID NO: 392238 - DNA, 567 bp, Homo sapiens
  misc_feature: GZ8MTXP02FIC04.39.81.H04.1.454.CMB.2.raw
  modified_base (477)..(477): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttaacaatggtcacacaaaagtatgccacacgaaccctccgagggccagtgccaccatcgaaccacacgacaacatacccaacgagcctaccggcctacatcggaccctagaggagtccagagatcaggacgacctacggccgttagtacttacnggtgcgagagagtacggggaaaattgtttcgaactggttaacccctgtttacgaccgttacgtcggggaccgaacgggtacccttacggg

SEQ ID NO: 392239 - DNA, 628 bp, Homo sapiens
  misc_feature: GZ8MTXP02IX6O3.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctattgaattggttcagcagaggccaggccaatctcaaggcacctaatttataaggtttcaaccgggactcgtgggtcccagacagattcagcgcagtggtcaggcactgaattcacactagaaaatacagacgagggtaggaggcgtaggaggtagttgggtttaggggtttattacgtggtactagtacgacgaaacgggaacaaccgtaccgtacggtcccgttaccgttaacgttaccgtttttacgggaccgtaacgggggtaaacccgaacggtaccgttagggaaacgtaaacgttaaccgaaaaaccggtaacgttacggtaacgggtccgttacggacccgtaaccgtaactttaccgttacgtttcccg

SEQ ID NO: 392240 - DNA, 700 bp, Homo sapiens
  misc_feature: GZ8MTXP02J17P5.39.81.H04.1.454.CMB.2.raw
  modified_base (273)..(273): a, c, t, g, unknown or other
  modified_base (347)..(347): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttggagtggatgggatggatcagcgcttaacaatggtacaacaacaaaactntgacccaacacgaaacctccgagggcaaggacgtcaaccagtcgaaccacaacgaccaacctaactacccgaacgaacgacccgaaccggacccttaacgaacgttacgggaacccttagggaaccggggaacgcccgttaggaacggtacttaccggtacgggaaacccggtaccgaacccgggggtcccgtttaagggttaacctttaccgtgggtacgacggtaaggaaacggtaaggtacgggggtaaaaatttcgttttacggaaccgtttacgggttaacccttcgtttaacggaaccgttacgggttaccgggggacccgtaaacgggggtaacccctttccgggg

SEQ ID NO: 392241 - DNA, 665 bp, Homo sapiens
  misc_feature: GZ8MTXP02FNAFG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctggttacacctttaccaactatggtatcgtaggttgggtgcgacacggcccctgggacaagggcttggagtggagtgggagtgggatcgagcgtacttaacaagttcggacaacaacaaaactatacgaccaacacgaacctaccgacggggacaggacgtaccaacctagtacgaacccacgaaacgaccaaacacctaccaacgacgaccgaccgtacccacgacgtacgggaccgtaggaacggacgaccgtaggaacgtacgtccgtacggaacggacccgacgggtccggtagttaacttagtgtacgacggaaggacggtaggtaccggggtaaaatttacgtttacgaaccgttcggttaaccttcgtttacgaaccgttacgggtcggggtaaccgaacggggtacccgttaccggg

SEQ ID NO: 392242 - DNA, 607 bp, Homo sapiens
  misc_feature: GZ8MTXP02F0A71.39.81.H04.1.454.CMB.2.raw
  modified_base (355)..(355): a, c, t, g, unknown or other
  modified_base (498)..(498): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacgaggcccctaggacgaaggcttgagtggatgggatggatcgagcgtacttagaatggtcaacactaaaacgtancgaccacacgaacctcgaggacagcacacagacgaccacacacacacaccgacgacgaccgaccgacctagacgtcgactagggacgtacgcgtagacgctcgacggaaccgaccgtacggtcgttagttaacgtcggtaggngacggaacggtaaggtacggtaaacgggttaaatttacgtttacgacgtttaccggttaccgttcgtttacggacgttaccggaccgggaccgtaccggtaccgtacgg

SEQ ID NO: 392243 - DNA, 627 bp, Homo sapiens
  misc_feature: GZ8MTXP02G5TGG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttacaactatggtatcgaggttgggtgcgacgacggcccctggacaagggtcttggagtggagtgggatggatcgagcgcttaacagtggtacaacaaactaaactagtcgacccaacgaacgaaccctacgacgggacaagcgtacaacctagacgaaccaacaacgtaccaacactacccgaagacgaccgacccggacctaacgagtacggaccgtaggaacggacgccgtagacgtactcgacggaaccgaccgacggtccgttagttacgttaccgtggtacggacggaaggaggtaacggttaacgggtaaatttgtttacgacgttcgttacctgttacgacgttacggcggtaccgacggtactccgg

SEQ ID NO: 392244 - DNA, 662 bp, Homo sapiens
  misc_feature: GZ8MTXP02FVD9L.39.81.H04.1.454.CMB.2.raw
  modified_base (275)..(275): a, c, t, g, unknown or other
  modified_base (367)..(367): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaaggcttgagtggatgggatggatcagcgcttacatggtcacaacaaactatgaccacacgaacctcgagggcagngtcaccatcgaccacagacacatacccaacgacgccaacggacccaacgagtacggaccctaggacggacgcccgtaggacgattccgacggaaccgaaccgtaccggggtacccgttaggtttaacttaccggtaggtacgggacggtaaacggacgggtaaaggttaccgggggtaaaaatttcggtttttaacggaacccggtttcgggtttaaacccccttggttttaacggaacccgttaccggggttacgggggaccccgtaaaccgggggaaccccctttaccggggg

SEQ ID NO: 392245 - DNA, 745 bp, Homo sapiens
  misc_feature: GZ8MTXP02HXWA4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggctgagtggatgggatggatcgagcgtacttaacaatcggtacaacaaacaaaactatagacccaacaacgaaccctccgaaggggccaaggacgtccaaaccatacgaacccaacaagaccacactacccgaacgacgaccaaccggccctaacgagtcggaaccctggaacggaacgcccgttagaacgtacgttaccgacggaacccggaaccgtaacccggggtaccggtttacggttaaacgtttaaccggtgggtacgggtaaccggtaaaggggtaaacgggttaacggggttaaaccggggggtaaaaatttttacggttttttaaccgggaaacccggtttttaccggggttaacccctttaacggtttttaacggaaacccgttttaccggggtaacgggggtaccccgtaaaccgggggttaaacccccgtttcggggg

SEQ ID NO: 392246 - DNA, 695 bp, Homo sapiens
  misc_feature: GZ8MTXP02IL7KM.39.81.H04.1.454.CMB.2.raw
  modified_base (259)..(259): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaaggtctcctgcaaggcttctggttactacctttacaactntgtatcgagttgggtgcgacgacggcccctggacaagggtcttggagtggagtgggatggatcgagcgtactaacagtggtaccaacaaactaaactatacgaccacaacgtaaccctcgagggtacagtaccgtacaaccacgtacgaacccacgaacgaccaacgactacccgaacgacgaccaacccgggtactaacgacgtaccggaccgtaggaacggaccgtacccgtaggacggtaacttacgacggaaacccgacggaaccggtccgttaagtaacgtttacggaggtacgaacggtacggaaacggttaacggtaaacgggttaaaagtttacggtttaccggtaccgtttacccggttaccgttaacggtttaccggtaaccggttaccgggtaccggggtacccggtaaccgggtacccgttcgg

SEQ ID NO: 392247 - DNA, 586 bp, Homo sapiens
  misc_feature: GZ8MTXP02JBGAF.39.81.H04.1.454.CMB.2.raw
  modified_base (391)..(391): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggtactacctttacaactatggtatctaggttgggtgcgacacggcccctggacaagggtctgagtggagtgggatggatcgagcgtcttacgaagtggtacacaacaaactatcgaccacacgacctcgaggcagcgtcacatcgacanacgacacactaccacgacgacaccggacctacgagtacggacctaggaggacgcctaggacgtatcgtagaaccgacaccggtcgtagttactagtgagtcgaaggagtaggtaacgggtaaatttcgtttacgtacgttcggtaccttcgttacggaccgttacggtccggggtaccgacggggtaaccctcgg

SEQ ID NO: 392248 - DNA, 647 bp, Homo sapiens
  misc_feature: GZ8MTXP02G9KGV.39.81.H04.1.454.CMB.2.raw
  modified_base (155)..(155): a, c, t, g, unknown or other
  modified_base (371)..(371): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccgagtggggatgttgngatgactcagtctccagtcctcccgtgccccgtcacccgttggacacgccgcctcatctcctgcaggtctagtacaaagcctacgtatacattgaataggaaactacctacttgaatttggttcagcagcgcaggcaatctaccgaaggctacttaaatttagtaagtttaccgaacggtctcgtcggggtaccagacagtactcgagcgctaggnggtcaggctagtgaacttcgaactacgtaagaaactcgagaacggaggggtacgaaggtcgtaggtaggtagtttgggtttaggggttttattacgtagacgttagtacggaacgaaaggtaacctacgaccggttcggtacccgttccgttaaaaccgttcggtttaaccgggaccgggtaaacgggtacccgtaaaggtccgtaaggggtactaacgtaaccgtaaaacggaaccgttaggtacggtactacggacctaacggttactttaccg

SEQ ID NO: 392249 - DNA, 645 bp, Homo sapiens
  misc_feature: GZ8MTXP02GDHHJ.39.81.H04.1.454.CMB.2.raw
  modified_base (253)..(253): a, c, t, g, unknown or other
  modified_base (265)..(265): a, c, t, g, unknown or other
  modified_base (270)..(270): a, c, t, g, unknown or other
  modified_base (336)..(336): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctgtacaccttacatntgtatcagtggncgacncggccctggacaggcttgagtggatggatggatcgagtcgcttaacagtggtacaacaacaaactntagaccaacacgaacctccgagggacagacgtcaacctagtaccgaacccagaacgaccaaactacgtacccaaccggacgacccgaacccgggaccctaacgagtaccgggaacctaggggaaggtaccgccgttaggaacgtactacgtacggaaccgtaaccgtacgggcccggtttagttaacgttaccgtgggtcgacggtaaggagtaaacggtacggggttaaaattcgtttacgaccgttcggtttacccttgtttaccgaacgttacggtcggggaccgtaaccggggtacccgttacgg

SEQ ID NO: 392250 - DNA, 661 bp, Homo sapiens
  misc_feature: GZ8MTXP02HSKVF.39.81.H04.1.454.CMB.2.raw
  modified_base (509)..(509): a, c, t, g, unknown or other
  modified_base (551)..(551): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgcaaggtcttcgtggttacaccttttaccaactatggtatcgtaggttgggtgcgacacggccccgtaggacgaagggcttaggagtggagtgggagtggactcgagcgacttaacgaagttcggtacaaactaacaaaactgtacgacccgaacaacgtaaacccctcgaaggggccaaggtacgtaccaaccagtaccgaaccaacgaagaacccaaactactaccccgaggaaacgcccgaaccggtaccctaacaagtcggaacctggacgganccgagagtatcgagaccgacgtaccggcgtagtaaacttcgngtacgcgaggtaggtaacggtaacgggtaaattttacggttacggaccgttacggttacccttaagtttacgaacgttacgggccggggtaaccgtacgggtaccgtcgg

SEQ ID NO: 392251 - DNA, 538 bp, Homo sapiens
  misc_feature: GZ8MTXP02G9GKE.39.81.H04.1.454.CMB.2.raw
  modified_base (249)..(249): a, c, t, g, unknown or other
  modified_base (282)..(282): a, c, t, g, unknown or other
  modified_base (288)..(288): a, c, t, g, unknown or other
  modified_base (352)..(352): a, c, t, g, unknown or other
  modified_base (364)..(364): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatgaaacncctatgaattggtcagcagagccaggccaatcncaagcnctaaattataaggtttcaacgggctctggggtccagacagactcagcgcaggtggtcaggcacngaattcacactnaaaatcagacgaggtggagctgaggagtgttggggtttattagtgacagtgacgaaggaaacacgtactacggtacctaccggttactacgtttacggaccgaacggggtaaccgaaacgcgttaggaaggtaacacgaaaacgaacgtaaggtcgactcgaccactactctcg

SEQ ID NO: 392252 - DNA, 644 bp, Homo sapiens
  misc_feature: GZ8MTXP02JKNK4.39.81.H04.1.454.CMB.2.raw
  modified_base (261)..(261): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggcttcgtggttacacctttacaactntggtacagtaggtggtgacgagaccggccgtaggaacgacggtcgtggaggtggtgtggagtggtgtgcgcgtactaagtacggtcggacaacaaactaacgtagtcgacccaacgaccgaccgtacggaggacgagtcaccaacgtacgtccgaaccaacgaaaccaaccaaactaccgtaacccggaacggacaacccccggtacgacccttaaacggcggtacccggtaaggacgaggaccgtcgtaggaactcgtacggacggtaaccaccggtacggtcttagtactggcgtaggacgtaagtacgtagggaaacgtttatttcgtcgaacggtcctttacgtgtacgtacgttcggggcgaaccgttaccggcttcg

SEQ ID NO: 392253 - DNA, 669 bp, Homo sapiens
  misc_feature: GZ8MTXP02HNNHW.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccctttaccaactatggtatctagttggggtgcgacgacggcccctggacaagggcttgagtggagtgggatggatcgagcgtcttacaagtggtcaacaacaaactatcgaccaacacgaaccctaccgaggggaccagacgtccaacagtcgaacccaacgagaacccaacactcccaacgacgaccgaacccggacctaacagtacggaccgtgaaggacgccgtagaacgtatcgtacggaaccgacgaacgggccgttcgtaacgtttacgtggtcgaccggaacggaggtaaccgtaacgggggtaaaatttaggtttttacgaccggtttacggttaccccgttttaacgtttacggtaaccggttacggttaccgggggacccgtaaaccgggggttaaaccccggtttcccggg

SEQ ID NO: 392254 - DNA, 577 bp, Homo sapiens
  misc_feature: GZ8MTXP02JNYOM.39.81.H04.1.454.CMB.2.raw
  modified_base (240)..(240): a, c, t, g, unknown or other
  modified_base (266)..(266): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctccagtcctccctgcccgtcacccttggacagcccggcctccatctcctgcaggtctagtcaaagtcctacgtatacnttgatagaaacactattgattggtanagcagagcagccaatcacaggctactaattataggttacaacggctcgtgggaccagtacagtatccgagcgcaggtggcaggcactagaacttacatactagaaactcgagacgagggtggacggtagtaggtaggagttagggtttagggttacttagtgcgtagtcgaacgaaggaaccacgtacgtacgccgttaccgtaacgttacggtttacgggacgtaacggggaccgaaaggtccggtaaggaacgtaacgaacgtaaaccgtacgtaggtcgacgtacgacctactacttacgtcttaccg

SEQ ID NO: 392255 - DNA, 656 bp, Homo sapiens
  misc_feature: GZ8MTXP02JFZGN.39.81.H04.1.454.CMB.2.raw
  modified_base (421)..(421): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttaccaatatggtatcagttggtgcgacacggcccctggacaaggtctggagtggagtgggatggatcgagccgtacttaacaaagttcggtacaaccaacaaaacctatcgaccaacgaacgaaaccctaccgaggggaccaaggacgtccaaaccgtagtacgaaccccanaacgacaaaccgtatacccgaacgacgaccgaaccggaccctacgaacgtacggacccgtagaacgggaacgtccgtaggtaacgtactccgtacggaaccgtaccggaccgggtaccgtggttaacttacgtggtacgacggaggaggtacgtaacggggtaaattacgttttggaccgttcgttacccttgttacgacgttacggacggacccggtacgggtaaccgttccgg

SEQ ID NO: 392256 - DNA, 750 bp, Homo sapiens
  misc_feature: GZ8MTXP02IIQ6U.39.81.H04.1.454.CMB.2.raw
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtctccctcgcccgtcacccttggacagccgcctccatctcctgcaggtctagtcaagcctgtatacattagataggaaactacctacttgtaattggttacagcagacggacccaggcccaatctacccaaggtccgtaccttaaagtttactaaaggtttacctaaaccggggtaccttcggtacggggtaccccctaaagtaaccgtagtacgttacccgacggccgggtacgtaacgggtggggtccaagggcctaaaccgttgtaaaactttccgaaactaaccgttaaagaaaaacgtaccgaagggtaaccggtaagggggttacggaaaggggtcgtagggtaaggggttaacggttttagggtttacggggttttacttaacgttgggacctaagttagggaaccgaaacggtaaaacgacctaccggtaccggtcccgttacccggttacgttaccggttttagggaccccggtaaggggtaacccgaagggtccgtaaagggaacgtaacgtaaccgtaaaacggaccgttaggaacggtacgtaacgacgtaacccgtacgttcttacgtc

SEQ ID NO: 392257 - DNA, 677 bp, Homo sapiens
  misc_feature: GZ8MTXP02JJDP4.39.81.H04.1.454.CMB.2.raw
  modified_base (559)..(559): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgaaggtcttcgttggttaacctacctttaaccaacttagtggtatcgtaggttggggtgccgacgacggcccctagggacgtaagggtcttggaggtggagtgggtagtggtactcgaggtcgtacttaacgaagtcggtacaacgtaaactaaactagtacaccgtaaccaacgtaaccctacggaggggaccaaggtccgtaccaaaccgtagtaccgaaccacgaaacgaaccaaccgactacccgaacgacgaccgaacccgtacctaccgagtccggaaccgtagaacggtcgacctaggacgacttcggacggaacgaccncggtccgtagttacgtcgtagcgagaggtagtacggaacgggttattacgttacgtacgttaccgttaccgttgttacgaccggttacggacgggtaccgtaccgggtacctaccggg

SEQ ID NO: 392258 - DNA, 704 bp, Homo sapiens
  misc_feature: GZ8MTXP02JMAOF.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctggttactacctttacaactatggtatcgaggttggtgcgacacggcccctggacaaggcttgagtggagtgggatggatcgaggcgtacttaacgaagtcggtacaactaaactaaaactatcgacccgacaacggaaacctccgagggacaggactacacagtcgaaccacgagaccacactaccgacgacgaccaaccggtcctaacgacgtacggacctaggacgggaaccgcgttacggaacgtaacgtccgtaacggaaccgaacccgtaaccggtacccgttagttaacgttacgttacggtggacggtaaaggtacggtaaacggtaaacggggtaaaattttaacggttttacggtaacccggtttacggttaaccccgttcgttttaacggtaaacccggttacggggttaccgggggtaacccggtaaaccgggggttaaccccgtttaccggg

SEQ ID NO: 392259 - DNA, 650 bp, Homo sapiens
  misc_feature: GZ8MTXP02H8VQA.39.81.H04.1.454.CMB.2.raw
  modified_base (560)..(560): a, c, t, g, unknown or other
  modified_base (566)..(566): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactaccttaccaactatggtatcaggttgggtgcgacgacggcccctggacgaagggcttgagtggagtgggatggatcgagcgtacttaacaagtggtacaacgaaactaaaactagtacgacccaaccgtaaacgtaaaccccctaccggaacggggaccaacgggtacgttacccaaaccctagtaccgaaaccccaacgaaacgaaaccaacctactacccgaacgacgaccgaccggtaccctacgacgtacggacctgaggtacgcccgtagacgtatcgaggaccgacgtacggtccgtagtacttacgngtacgngaagacgaggtaacggtaaatttgttacgacgttacgtacccgtttgtacgtacgtacggtacgggaccgtaacggtaccgtcg

SEQ ID NO: 392260 - DNA, 680 bp, Homo sapiens
  misc_feature: GZ8MTXP02FHHHC.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggagtgggatgggatcagcgcttacaatggtacacaacaaactatgccacagaacctccgagggcagagtcaccatcgaccacagacacatacccacgacgaccgaaccggccctaacgagtacgggaccctagggacgggaacggccctaggaacgtacgtaccgtacgggaaaccgaaccgaaacccggggcccgttaggttaacttaccgtggttacggacgtaaagggaaggtaacggttaacgggggtaaaaactttagtttttacggaaaccgtttacggggttaaaccccctttaacggttttacggtaacccggtttaccgggtaccgggggtacccgtaaccgggggtaaaaccccctttccggggg

SEQ ID NO: 392261 - DNA, 639 bp, Homo sapiens
  misc_feature: GZ8MTXP02HGT8L.39.81.H04.1.454.CMB.2.raw
  modified_base (275)..(275): a, c, t, g, unknown or other
  modified_base (280)..(280): a, c, t, g, unknown or other
  modified_base (326)..(326): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttcgtggttacacctttacaactatggtatcagttggncgacnggcccctggacaaggctgagtggatgggatggatcagcgacttaanaagtggtacaacaacgaaaactatcgacaaccaacgaacctcgagggcagacgtacaaccatacgaacccaacaacgaacaacaacgtacccaacggacgaccgaaccggcctaaacagtaccgggaaccctggaaacggtacgacccgtaggacgtaatccgtaagaaccgaaccgacgggtacccgttagttaacgttaaccgtgtagcggaaaggacggtacggtaaggggtaaaatttcgtttacggaacgttaccggttaacccttgtttacgacgttacggtccggggaaccgtaacgggtaccccg

SEQ ID NO: 392262 - DNA, 721 bp, Homo sapiens
  misc_feature: GZ8MTXP02HK74R.39.81.H04.1.454.CMB.2.raw
  modified_base (246)..(246): a, c, t, g, unknown or other
  modified_base (257)..(257): a, c, t, g, unknown or other
  modified_base (275)..(275): a, c, t, g, unknown or other
  modified_base (430)..(430): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacnccttacaactntggtatcgagttggggtncgtacacggcccctaggacaaggcttgacgtggatggatggatcgagcgtacttagaagtggacacaactaaactgtcgacctaacacgtaaccgtccgaaggggccaaggacggtaccaacgattaccgaacctaacgaacgtaccaaccgtanacccgaacgacgacctaccgggtacttaacgaacgtcggttaacccgtgggaaaccggaaacgtcccttaaagggacgtacgttaccgtaacgggaccgtaaaccggaccgggtacccgtttaggttaaaccgttcggttacgtacggaaccggttaacggaaccgtacgggttaaacccggggtaaaattttcggtttacgggaaccgtttacggttaacccgtttcggttacgtaaaccggttccggttacgggggaccccgttaacgggggtaaaccccctttcgggg

SEQ ID NO: 392263 - DNA, 722 bp, Homo sapiens
  misc_feature: GZ8MTXP02IEYG8.39.81.H04.1.454.CMB.2.raw
  modified_base (353)..(353): a, c, t, g, unknown or other
  modified_base (428)..(428): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcagcttctgtactaccttacactatggtatcagttgggtgcgacacggcccctggacaagggcttgagtggatggggatgggatcgagcgtacttaacgaattggtacaacaaaccaaaacttntacgccaaccaacgaaacccctccgaaggggcaaggacgtcccaacagtacgaaccccaacaagaaccaaccaancccgaaacggacgacccgaaccggtaccctaacgacgtacgggacccgtaggacggacgacccgtaaggacgttaacgtccgtaagggaacccgaaccgtaccgggtcccggttagttaacgtttaccggtgggttaacggacggtaaacgggtaacggttaacgggttaaacggggtttaaaatttaacggttttacgtaaccggttttaccggttacccgtttaacggtttacggtaaccggttaccggggtaccggggtaacccggtaaaccggggttaaccccgttcggg

SEQ ID NO: 392264 - DNA, 634 bp, Homo sapiens
  misc_feature: GZ8MTXP02HUI1Z.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctacctgcaaggtcttctaggttactacctttaaccaactagtggtaatcgtaggttggggtgacgacgacggtcccccgtaggaaccgaagggtcttaggagtggagtgggatggatcgagcgtacttaacgaagtcggtacacgaaactaaaactagtacgacccaacgtaaccgaaccctacggaaggggacaacgtcgtaccaaccagtacgaacccaacgacgaaccctaacacctacccgaacgaccggaccgaaccggtacccttaacgacggttacgggaaaccctggaacggacgtcccgagagtactcacgggaacgacgtacggcctagttatacgtgacgagagagtagacggtaaattcgttgactcggacctgtgactcggcggcacggtacgcg

SEQ ID NO: 392265 - DNA, 745 bp, Homo sapiens
  misc_feature: GZ8MTXP02I0RY2.39.81.H04.1.454.CMB.2.raw
  modified_base (626)..(626): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatgtatcgtaggttggtgcgacgacggcccctaggacgtaacgggcttaggagtggtagtgggtagtggactcgagtccgtacttaacgaagttcggtaccaaaccgtaaacgtaaaccgttagtacggacccctaaaccgacgtaaacccgtaccggtaacggggacctaacgggtaccgttccaaacccgtacgtaccgaaccccgaacgtaaccggtaacccaaaccgtacctacccgaacggtaccgacccgtaacccggtaccctaaccgacggttaccgtacccgtaggacggtaccgtccgttaggaacgtcgttaccgaggtaacccgaacgtcccggtaccgttagtaacgttaccgnggttacggacggtaaacggtcgtaaacggggtaccgggttaaaatttcggtttacgaccgtttccggttaaccttgttcgtaaccgttacggtcggtaccggtacgtacccgtttacgg

SEQ ID NO: 392266 - DNA, 708 bp, Homo sapiens
  misc_feature: GZ8MTXP02GNYM7.39.81.H04.1.454.CMB.2.raw
  modified_base (214)..(214): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttaccaactatggtatcagttggtgcgacaggcccctggacaaggcttgagtggagtgggatggatcgagcgtacttaacaagtggtacaacaacaaaactatcgaccaacacgaaccctaccgacggggacaaggacgtaccaaccaagtacgaacccaacacgaaaccaacactacccaacgacgacgaccggaccctacgagtcggaacctggaacggacgcccgtaggacgtactaccgtacgggaaccggaacccgaccgggtacccgttaggttaacgtttaccggtacggtaggaccggaaaggtaacggtaaacgggttaaccgggggttaaaaatttacggtttttacggaaaccgttttacggttaacccccgtttaacgttttacggtaaccggtttaaccggtaccgggggtaacccgtaaaccgggggttaacccggttacccggg

SEQ ID NO: 392267 - DNA, 611 bp, Homo sapiens
  misc_feature: GZ8MTXP02GR8SE.39.81.H04.1.454.CMB.2.raw
  modified_base (215)..(215): a, c, t, g, unknown or other
  modified_base (274)..(274): a, c, t, g, unknown or other
  modified_base (279)..(279): a, c, t, g, unknown or other
  modified_base (350)..(350): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtctcctgcaaggcttctgttacaccttacaactatggtatcgtagttggtncgacncggccctggacgaggtctggagtggagtgggatggatcgagcgtacttacaagtcggtacaacaacaaatntcgaccacacgtaacctcgaggccaggcgtaccacatcgaaccagacgacacgactacccgagacgacgaccggacctacgagtcggaacctggacggacgaccgtaggaagacgttcgacgggaccgaaccggtaccggtcgttagtacgttacgtgtggacgaaggagtacggtaacggggttaaaatttacggtttagaccgttcgttacccttgtttacgacgttacggtacggggaccgtaacgggtaccgttcgg

SEQ ID NO: 392268 - DNA, 632 bp, Homo sapiens
  misc_feature: GZ8MTXP02F4QQZ.39.81.H04.1.454.CMB.2.raw
  modified_base (276)..(276): a, c, t, g, unknown or other
  modified_base (288)..(288): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcggtctccagtcctccctgcccgtcacccttggacacgccggcctccatctcctgcaggtctagtacaaagcctacgtatacattgataggaaactactattgaattggttcagcagngccagccaatcncagcactaattataagttctacggctcgtggccagacagatcacgcgacaggtggacaggctacgtgaacttcaacactaagaaaatcgaagacgtaggggtaggaggtcgtaggaaggtagtttgggtttaggggtttaacttacgtgtacgtagtaggacgtaaaggaactaacgacgtaccggtaccgttaccgttaaccgttacggttttacggaccggtaaacgggggaacccaaaggtacgtaggaaacggtaaactaaaccgtaaaacggtaaaccgtgggtacggtaacgttacggaaccgtaacccgtattaccgttacggtttcctttaacccg

SEQ ID NO: 392269 - DNA, 669 bp, Homo sapiens
  misc_feature: GZ8MTXP02HQYAX.39.81.H04.1.454.CMB.2.raw
  modified_base (334)..(334): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactaccctttacaacttatggtatctaggttgggtgcgacaggcccctggacgaaggtcttgagtggatgggatggatcagcgtacttanaagtcggtacaacgaacaaatatagacccaacaacgaaccctccgaggggaccaaggtacgtaccaaacagtaccgaacccacgaagtaaccaacactacccgaacgacgccgaacccgggtaccctaacgaacgttacgggaaccctagggaacgggacgtacccgttaggaacgtacttccgaacgggaaccgaccgaccgggtcccgtagttacttacgtacgtggacgagaggtaacggtacggggtaaatttacgtttacgaccgtttacggtaacccttcgtttgaaaccgttcggtaccggggtaccgtacggggtaacccgttcggg

SEQ ID NO: 392270 - DNA, 751 bp, Homo sapiens
  misc_feature: GZ8MTXP02JNXR8.39.81.H04.1.454.CMB.2.raw
  modified_base (348)..(348): a, c, t, g, unknown or other
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgacaaggtcttctggttactacctttaaccaacttatggtactcgtaggttgggtgcgacgacggccccgtaggacgaaggtcttaggagtggagtggagtggatcgagtcgtacttaanaagtcggtacaacaaacaaactatagaccaacgaacgaacccgtaccgagggaccaagacgtacaaacctagacgaaccaacgaacaactaacacaccaacgacgacgaaccgacacgagtacggaacctagggaacgacgtcctaaggacgtacgttacgaacgggaaacccgtaccggacccggttaccggttaaggtttaaaactttccggttagggtacggtaaccgggtaaacgggaaggttaaaaccgggttaaacgggggttaaaaattttagggtttttaaccggtaaaaccgtttacccgggtttaacccttaaccgggttttacggtaaaacccgtttaccggggacccgggggtaacccggtaaaacccggggttaaccgtttaaccccggg

SEQ ID NO: 392271 - DNA, 588 bp, Homo sapiens
  misc_feature: GZ8MTXP02IJPU1.39.81.H04.1.454.CMB.2.raw
  modified_base (249)..(249): a, c, t, g, unknown or other
  modified_base (312)..(312): a, c, t, g, unknown or other
  modified_base (329)..(329): a, c, t, g, unknown or other
  modified_base (334)..(334): a, c, t, g, unknown or other
  modified_base (395)..(395): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctctgcaggtctagtcaaagcctgtatacattgataggaaacncctattgaatttgttcagcagaggcagccatcacgagcactaattagtacgttctaaccgggntcgtgggccagcagctnagcgnaggtggcaggcacgtagtattccaacaactagtaaaatccgagcgtaggggtggaggtcgnggaggtagttagggtttaggggtttacttacgtgacgtagtcgacgtaacggaaaccacgtacgtacggtcccgttaccgtacgttaccgttttacggaccggtaacggggtaaccaacggtcggtacgggaaacgtaacgtaaacgaacgtaacgtggtaacgtcgtacgaccgtaacacgttcgtttaccg

SEQ ID NO: 392272 - DNA, 676 bp, Homo sapiens
  misc_feature: GZ8MTXP02JZGKB.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacaccttacaactatgtatctaggttggtgcgacacggccccgtggacgaagggtcttggagtggagtggagtggatcgagcgtacttaacgaagtcggtaccaacaaacaaaactagtacgacccaaacaacgtaacccgtaccgacggggacaaggtaccgtaccaaaccgagtaccgaaaccaaccgaaacgacccaaacctaacgacccgaacgacgaccgaaccgacctaacacgtcgacgtgacggacgcgagagtactcgacggaccgacgtaccggtaccgttaggttacttacggtgtacggacgaaggaacggtaagggtacggttaaaagtttacgtttacggaccgtttaccggtttacccgttcgtttacggaacgttaccggggtacgggacccggtaacggggtaacccgtttacgg

SEQ ID NO: 392273 - DNA, 700 bp, Homo sapiens
  misc_feature: GZ8MTXP02IJ781.39.81.H04.1.454.CMB.2.raw
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaaacaacaggtgcccactcccaggttcagctggtacagtctggagctgagatgacgaaggccgtggggcctcagtgaaggtcctcctgcaaggcttcgtgttacctacctttaccaactatggtatcgtagttgggtgcgacacggcccctggaacgaggcttggaggtggagtgggatggatcgagcgtacttacaagtcgtaacacgaaactaaatntcgacccaacgacgtaaaccctcggaaggaccgaagtacgtccaaaccgaagtaccgaaaccacgaaacgtaaccaacgactacccgaacgacgaccgaacccgtacctaacgacgtacggacctaggacggaacgccgtaagacgtaactcgacggaaaccgcgtaaccggtacgttagttaaccgttggttagacggaacggtaaggtaacgggtaggttaaaccgggggttaaaatttacggttttacggaaccgttttccggttaacctttcgtttaccgtaacggttacggtaccggggtacccggtaaccgggtacccgtttaccggg

SEQ ID NO: 392274 - DNA, 778 bp, Homo sapiens
  misc_feature: GZ8MTXP02H7U5V.39.81.H04.1.454.CMB.2.raw
  modified_base (431)..(431): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttacaactatggtatcgagttggtgcgacacggcccctggacaagggtcttgagtggagtgggatggatcgagcgtacttaacaagttcggtaccaacgtaaaccaaaacttagtcgtaccccaacgaaccgaacccctccgaaggggccaaggcgtaccaaccagtaccgaacccaanacgaaccaacgtacacccgaacgagtacccaaccggaccctaacgacggtacggtaaccgtaggacgggaccgtccgttagggacggtacttccgtacggaaccggaccgtaacccgggtcggttacgttaaacgtttcgtacgggtcggaccgggtaaaggaaacgggttacgggttaaaaccgggggttaaaaatttttaccgggtttttaacgggtaacccggtttacccggggtttttaaaaccccctttcggtttttaaccgggtaaaccccggtttaccgggggttaaccggggggtaacccccgttaaaacccgggggtttaaaccccggtttcccgggg

SEQ ID NO: 392275 - DNA, 603 bp, Homo sapiens
  misc_feature: GZ8MTXP02IP96Z.39.81.H04.1.454.CMB.2.raw
  modified_base (348)..(348): a, c, t, g, unknown or other
  modified_base (391)..(391): a, c, t, g, unknown or other
  modified_base (399)..(399): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacaccctttacaactatggtatcagttgggtgcgacaggcccctggacaagggctggagtggagtggggatggatcagcgacttacaatggtacacaactaatangaccaacacgaaccctcgagggacagcgtccacatcgacccanagacaacntaccacgacgcgtaaccgacctacagtacggaccagaggacgtccgtagagacttcgaggaacccgaccgaccggtcggttacgtaagttcgtaggtcgacggtaagaggtaaggtacgggggttaaaattcgttttacgacgttacgggttacccttgtttacgaccgttacggacggggtacccgtacgggaacccgttcgg

SEQ ID NO: 392276 - DNA, 647 bp, Homo sapiens
  misc_feature: GZ8MTXP02HQA7U.39.81.H04.1.454.CMB.2.raw
  modified_base (369)..(369): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttacaactatggtatcgaggttggggtgcgacgacggcccctgggaaccgaagggcttggaggtggagtggggatgggatcgagcgtacttaacagttcggtacaacaaacaaactntacgacccaacaacgtaaccctcgagggcaagcgtaccaaccatccgaaccacgaacgaccaaactctacccgacgacgaccgaccggtaccctaacgacgtacgggaaccgtagggaacgggtaccgcccgttaggacgtacgtccgtacgggaaccgaccgtacccgggtacgttagttacgttacgtggtgacggagaggtaggtaacgggtaaattcgtttacgaccttcggtcccttgttacgaccttcggacgggccgaacgggtacctcgg

SEQ ID NO: 392277 - DNA, 589 bp, Homo sapiens
  misc_feature: GZ8MTXP02HWMRY.39.81.H04.1.454.CMB.2.raw
  modified_base (290)..(290): a, c, t, g, unknown or other
  modified_base (322)..(322): a, c, t, g, unknown or other
  modified_base (357)..(357): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctactgaattggttcagcagagccagccaatctcaagcncctaattataaggtttctaaccgggacttcgngggtcccagacagacttcgagcggcaggtgggtcngggcaacgtgaaattcacgaatacgaaaatcgagcgaggggtaggaaggcgttagaggtaatggtttagggggtttattacgtgtcgagtgacgaaagggaacaccgaacgtacgggtccttaccggtacctacgttttacggaccgtaacggggaacctaaaggcgtagggaaacggtactaaccgaaaacgtaaacgtggtacggcctaggaccacccgtattacgttcg

SEQ ID NO: 392278 - DNA, 632 bp, Homo sapiens
  misc_feature: GZ8MTXP02G9CZU.39.81.H04.1.454.CMB.2.raw
  modified_base (359)..(359): a, c, t, g, unknown or other
  modified_base (418)..(418): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacttatggtatcgagttggggtgcgacgacggccccgtggacgaagggtcttggagtggagtgggatggatcagcgcttacaagtggtacacgaactaaaactntacgacccacaacgaaccctaccgacgggacaagacgtccaaccacgacgaccaacganaaccaacacacccgaacgacggaccaccggaccctaccgaagtcggacccagggaggacgacccgtagacgactcgtacggaccgaaccgaccgggtacgtcgttataacgtgcgtcggaagacggaggtaacgggtaaattatttacggtactaccggttaccgttcgtttacgacggttacggcggggtaccctacggggaaccctttcggg

SEQ ID NO: 392279 - DNA, 705 bp, Homo sapiens
  misc_feature: GZ8MTXP02HTKNU.39.81.H04.1.454.CMB.2.raw
  modified_base (284)..(284): a, c, t, g, unknown or other
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgaagtctcctgcaaggtcttcgttggttacctacctttaccaacttagtggtatcgtaggttgggtncgacgacggccccgtggaacgaagggtcttggagtggagtgggagtggatcgagcgtacgttacgaagttcggtacaacgaaactaaaacttactacgaccccgaaaccgaaaccggaaaccccctccgggaaacggggacaaacgggtaccgtacccaaacctaacgtaccgaaacccgaacgaaacgaaccaaaccaactacccgaaacgaccgaccgaaccgacctaacacgtacggaccgaggacgacgccgtagagtactacgacgaccgacgaccggtcgtagtacgttacgtggtacgaggaacgaaggttacggtaaacgggtaaatttagtttacgtaaccgtttacggttacccttaacggtttacgaccgttaccggggttacggacccggtaacggggttacccgtcgg

SEQ ID NO: 392280 - DNA, 537 bp, Homo sapiens
  misc_feature: GZ8MTXP02IAEL5.39.81.H04.1.454.CMB.2.raw
  modified_base (252)..(252): a, c, t, g, unknown or other
  modified_base (345)..(345): a, c, t, g, unknown or other
  modified_base (374)..(374): a, c, t, g, unknown or other
  modified_base (377)..(377): a, c, t, g, unknown or other
  modified_base (388)..(388): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacncctattgaattggttcagcagaggccaggccaatctcaaggcactaatttataagtttcaacggctgtggggtacccagacagattcgagcgnagtggcagcactgaatcaatacagaaatnagngagggtgacgngtagaggtatggttagggtttattactgactagtagacaaaggaacacgacgtcgaccttcgtaactacgttttcggaccgaagggggaccaaaggtccgtaggaagaactacaaaacggaactggtacggctaggcctaaacctatcg

SEQ ID NO: 392281 - DNA, 759 bp, Homo sapiens
  misc_feature: GZ8MTXP02HI0MQ.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacacctttaccaacttatggtatcgaggttgggtgcgacgcggcccctggacaagggtcttggagtggagtggggatggatcgagtcgtactttaacgaaagtaggaaaacaacgtaaagtatagaccctaactaattaaacgtttccgaaggggtacaggacgttccaaataccgagtaccgaaaccgaaccgaacgaacctaacacgtacccgacggaacgaccctacgtacgaccctaacgtaagttacgggaaactagggaaaccgtaacccgtaggtaaacgtacgtaccgtaacggaacccggtaaacgtaaccgggttacccttttaaagtttaacggtttaaagtttcggggtaaacggaccggtaaagggtaaaccgtaaaccgttaaaaaccgttttcccccgttaaacctttaaacgttaacgtttaaaccggttaaacccggtaaggttaacgttaagggggtaacctttaggtttaaccgtttttactttttaacccgg

SEQ ID NO: 392282 - DNA, 688 bp, Homo sapiens
  misc_feature: GZ8MTXP02HJJCA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgacaaggcttcgtggtactaccttaacaactagtggtatcgtaggttgggtgcgacgacggccccgtaggaacgaaggtcttggaggtggagtggagtggactcgagcgtctaacgagtcggtacaacaaacaaactatgacccacgaacgaacctcgaggacagacgtaccaacatacgaaccaacaacgaccacgtactacccgaaacgacgacccaaaccgtaccctaacgaacgttaccggaccgtaagggacggtacgtaccgtaggaacgtataccgacggaaccgaccgaccgggtctagttaaacgttgtacgggtagaccggtaagtagacgttacggtaaccgttaccttacgttaccttaaggttaacgggttaacgggggttaacggggttaaaatttaaaccggttaacggtttccggggttaacccggtaccccgggtaaccggggg

SEQ ID NO: 392283 - DNA, 765 bp, Homo sapiens
  misc_feature: GZ8MTXP02JVSW7.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctgtatacattgatggaaacacctactgaattggttcagcagacggccaggcccaatctaccgaaaggccgtaccttaaaattttacgtaaacgggttttacctaaacccggggtacttccggtacgggggtaccccaaggacctaaggacctttccgaacggtccgggacctagggttacggggtccaggggtacctaacgttaggtaaaactttccgaaaccgtaaaccgtttaacgggaaaaattacccgaaagggtaccggaacggggggttacggggaaaggggtcgttaaggggaaggggttaaggtttggggttttacggggggttttaaactttaaaccggtggtaccgtaggttacggaacggtaaacggggaaaccaacccgtaaccggttacggtacccgttacccggttaaccgttaccgttttacgggacccgtaaacgggggacccgtaaaggccgtagggaacgtaacgtaaccgaaaaccgtagtaacggtcggtaccgtacggaccacctaacgtacttcg

SEQ ID NO: 392284 - DNA, 723 bp, Homo sapiens
  misc_feature: GZ8MTXP02J1CHI.39.81.H04.1.454.CMB.2.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcaggtgaaggtctcctgcaaggcttcgtggttaccacctttaccaactatggtatcgaggttgggtgcgacgcggcccctaggaccgaagggtcttggagtggagtgggactggactcgaggcgtacttaacgaagtggtaccaacaaactaaaacgtatcggaccccaaaccgaacgtaaccccctacccggaggggacccaaagggtaccggtaccaaccctaagtaccgaaacccaaacaacgaacccaaccaacgtacccgaaccggaacgacccgaacccgggtccctaacgacgttacgggacccgtaggaacggacgtccgtaggacgtagtacgtacggaaccggacgaccgggtacgttacggttaacttacggtgtacgggacgaacgggtaggtaggtaacgggtaaaatttcgtttaacgaccgttaccggttaacccgttcgtttacgtaaccgttaccggttacggggacccggaacggggttaacccgtccggg

SEQ ID NO: 392285 - DNA, 671 bp, Homo sapiens
  misc_feature: GZ8MTXP02HBJKO.39.81.H04.1.454.CMB.2.raw
  modified_base (388)..(388): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcgagttgggtgcgacacggcccctggacgaggcttggagtggagtgggatgggatacagcgacttacagtggtacacgaacaaactatgaccacacgaacctcgaggcagtacgcaccgtanacgaccaacaacgaccacactacccgaacgacgaccgaaccgtaccaacgacggtaccggaaccgtaggaacggacgtacgtaggacgtagtaccgacggaaccggtaaccgaccgggtacgttacgttaacgttcgttaggtacgacggtaacggacggtaaacgggttaacggggttaaaactttacgtttaaccggtaccggtttaccgttacccgttaacggtttaccgtaaccggttacgggtaccggggaacccgggtaaccgggtaacccgttcgg

SEQ ID NO: 392286 - DNA, 647 bp, Homo sapiens
  misc_feature: GZ8MTXP02IZ62Q.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacaccttaccaactatgtatcagttgggtgcgacacggcccctggacgaagggcttggagtaggagtagggatgggatcgagcgtcttaacaagttcggtacacgaaactaaactagtacgaccaccaacgtaaccctaccggagggccaaggacgtccacccaagtaccgaccgaacaagtaccaaccactacccacgaagaccaccggacctacaacgtgggaccctaggagacggcctaggacgtatccgtaggaccgaaccgtacgggccgttagtaaactttcgtagcgacggtagacggtaggtaacggggttaaattacgttttagacgttacgggtttacccctaagtttacggacgttacgggacggggtaccgtaacgggtaacccgtttccgg

SEQ ID NO: 392287 - DNA, 629 bp, Homo sapiens
  misc_feature: GZ8MTXP02HL1XG.39.81.H04.1.454.CMB.2.raw
  modified_base (520)..(520): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacgacggccccgtggacaagggcttggagttggagtgggatggatcgagcgtcttacgaatcggtacaacgaaacaaacgtatacgaccactaacgaaccctcgaggccaagacgttaccaacatcgaccaacacgtaccaacatcccgaacgagaccgtaaccggccctaacgagtacggtaccgagaggacgcctaggagtaacttgacgaacgacgacgccgtagtacttacgttggngacgaggagtaggtacggggtaaattagtttcggactttacgggtacccctttaagttaggtacccgtttaaacggcggggtacccgacggggtaaacccgtttccggg

SEQ ID NO: 392288 - DNA, 577 bp, Homo sapiens
  misc_feature: GZ8MTXP02HSPGP.39.81.H04.1.454.CMB.2.raw
  modified_base (274)..(274): a, c, t, g, unknown or other
  modified_base (372)..(372): a, c, t, g, unknown or other
  modified_base (389)..(389): a, c, t, g, unknown or other
  modified_base (446)..(446): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacagggcttgagtggatgggatggatcagcgacttacaatggtacaacaacaaactatgaccaacagaacctccgagggccagngtcaacatcgaacccanacgacacactaccaacgagcacggacctacgagtcggaccgtgaggagcctgagtanctaggaccgacacgggtccgtagtacgttacgtagtgacgtaggagaacgtacggggaaattagttttcgaacgttggttaacccctgtttacgacgttacggtcggggacccaacggggtaacccgtcgg

SEQ ID NO: 392289 - DNA, 701 bp, Homo sapiens
  misc_feature: GZ8MTXP02GLYY2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacgacggcccctggacaaggggcttggagtggagtggggatggatcgagcgtacttacaagttcggtacaacaacaaaacttatacgacccaaccaacgaaaccctccgaaggggccaaggacgtaccaaaccgatccgaacccaacaacgaaccaaacactaccccgaacgaacgaccgtaacccggaccctaacgaacgtacgggaaaccctaggaacgggtaaccgccgtagaacgtacgtaccgtacgggaaccgaccgaccgggtccgttagttaacgtttaccgtggtacggacggtaaggaggtaacggtaacgggggtaaaattcgtttttacggaccgtttacgggttaacccttcgttttacggaaccgttaacgggtcggggtacccgtaacggggtaaccccgtttccggg

SEQ ID NO: 392290 - DNA, 770 bp, Homo sapiens
  misc_feature: GZ8MTXP02F0DV3.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgccccgtcacccttggacacgccggcctccatctcctgcaggtctagtcaaagtcctacgtatacattgatacggaaaactccttatgtaattcggttcagtcaggacggccaggaccaatcctacgaaggtccgtaccttaaagttttagtaacggtttaccgtaaacccggggtcttacggtcggggtacccaggaactagtaaccttcgacggcgggactagggtcgggtacacggcgtaacgtaggtaacttccgaaactacgtaagtaaaactcgaaacggtcggtaacgggggtgggaacggtacgtggggtaaaggttaacggtttgggttttagggggtttaaattacggtacggtacgtaacggttacggaccgtaaaacggggtaaaccctaaccggtaccggttaccgggttaccccgttaaccggtttacccgttaaccgggttttaccggggaacccgggtaaaaccgggggtaaccgaacggggtaccggttaagggtaaacgtaaccgtaaaaccggaaaaccggttaaacggtggtaacggtaccgtaccggacctaaccggttattccgtttaacgg

SEQ ID NO: 392291 - DNA, 704 bp, Homo sapiens
  misc_feature: GZ8MTXP02FYKV5.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacacggcccctggacaagggcttgagtggagtgggatggatcgagcgtcttaacgaatggtacaacaacaaaactatgcccaacaacgaaccctccgaaggggacaacgacgtccaaaccagtacgaacccacaacgaacacaactacccgaagaacgacccaaccggaccctaacgtaacgtaccgggaaccctagggaacgggtaccgaccgtaggaacgtacgtaccgtacgggaacccgaaccgttaccggggacccgtttagggttaaacctttaaccgtggggtacggtaaccggtaaagggaaccggtaaagggttacgggggtaaaaatttggtttttacgaaccgtttcggttaaacccttcgtttacgtaaccgtaccgggttcgggggaacccgtaaacggggtacccgttacggg

SEQ ID NO: 392292 - DNA, 689 bp, Homo sapiens
  misc_feature: GZ8MTXP02JZBMP.39.81.H04.1.454.CMB.2.raw
  modified_base (278)..(278): a, c, t, g, unknown or other
  modified_base (364)..(364): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttaccaactatggtatcgaggttgggngcgacgacggcccctggacgaaggggtcttaggaggtggagttggggatggatcaggcgtacttacagtcggtcaacaacaaactntagaccacagaaccctccgagggcagagtccacatcgaccacagacacatcccgaacgacgaccgaccggaccctaacgagtaccggaacctgggaacgggacgccgttaggacggtataccgtacgggaacccgtacggtacccggtaccgggtttacgttaacgtttaaccggtgggtacggtacggggaaggaaacggggttaggttaaacgggggttaaaattttcggttttaacggtaaccgtttaccgggtttaccctttcggtttaacgtaccgttacgggttacggggtacccggtaacggggtacccgttaccggg

SEQ ID NO: 392293 - DNA, 565 bp, Homo sapiens
  misc_feature: GZ8MTXP02JNRJZ.39.81.H04.1.454.CMB.2.raw
  modified_base (286)..(286): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctcctgcaggtctagtacaaagcctagtatacattgatggaaacacctatagattggttcagcagaggccaggccaatcncaagcgtacctaatttataaggttactaaccgggactcggtcgggtaccagacagtctcgagtcgctaggtagggaagcatgaattacaactaactagaaatcgaagcgaggggtggagtcgagagggtagtttgggttaggggtttatacgtagctagtacggaacgaaacggaacacgacgtcggacccttacgtacttacggttccggacgaaggggaccaaggtcgaggagactacgaaacgagtgtcggctacgaccgtacgactcgtactccg

SEQ ID NO: 392294 - DNA, 686 bp, Homo sapiens
  misc_feature: GZ8MTXP02J4FY1.39.81.H04.1.454.CMB.2.raw
  modified_base (342)..(342): a, c, t, g, unknown or other
  modified_base (345)..(345): a, c, t, g, unknown or other
  modified_base (349)..(349): a, c, t, g, unknown or other
  modified_base (365)..(365): a, c, t, g, unknown or other
  modified_base (374)..(374): a, c, t, g, unknown or other
tcagtcgcactagtcacgaccggtgctcgatttagtagtgtagattcgcgggggacccaaaaaccacaccctccttgggagaatcccctagatcacagctcctcaccatggactggacctgtagcatccttttcttggtggcagcaacaacaggtgcccactcccaggttcagctggtacagtctggagctgagatgacgaagcctggggcctcagtgaaggtctcctgcaaggcttctggttaccacctttacaactatggtatcagttgggtgcgacaggcccctggacaggcttgagtggatgggagtggatcagcgacttcaatgtcgcaacacaatnccncacncaacctcgacggtcgnggactaccnccacacacgaccacgaacaccaactaccgaccgacggaccgtaccggacccgtaccgtaacgtacgggtacggtacgtagggaacggtaccggtacgtacggtacgtacgttacggaccgggaacccgtaaccgggtaccggttaccggtttacgtttacgttacggttacgggtacggtaacgggaaggtaaacggttaacggggttaaacggtttaacgtttaacgtttcggtttaaccgtttccggtttaccccgtttaccgtttacggttaccggtaccggtttaaccggggtacccgggtaccgggg

SEQ ID NO: 392295 - DNA, 585 bp, Homo sapiens
  misc_feature: GZ8MTXP02GABCH.39.81.H04.1.454.CMB.2.raw
  modified_base (275)..(275): a, c, t, g, unknown or other
  modified_base (381)..(381): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaaggcttgagtggatgggatggatcagcgcttacaagtggtcacacaaactatgccacagaacctcgagggcagcgtcacatacgaccanagacacataccacgacgcaacggcctacagtcggacctgacggacgccgtagacgacgtcgtacggaccgaccgacgggccgtaggttaacttacgtggtacggacgtaaggacgtaggttacggggtaaaatttcgttttacgacgttcggtaacccttgtttacgacgttacgcgggggtacctacggggtaaccctttcgg

SEQ ID NO: 392296 - DNA, 802 bp, Homo sapiens
  misc_feature: GZ8MTXP02JWE8H.39.81.H04.1.454.CMB.2.raw
  modified_base (284)..(284): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctgcccgtcaccgttggacacgcccggcctccatcctcctacgaggtctagtacaaacgtcctacgtaatacattgatacggaaactcctatgaatttggttcagnagacggccaggacccaatcctaccgaacgggtccgtacctttaaattttaacgtaaggttttaccgtaaaccggggtacttcggttcggggtaccccagaaccgtaggaccctttacgacggccggacgtagggttcggggacacggggtaccctaacgttagtaacttaccgaactaaacctaagtaaaaacttcgaaacggccggtaagggggttacgggaaggtacgttagggaaggggttagtttagggggttttagggggttttaactttaaaccggtggtaccgtaaggttacgtaaacggtaaaacgggaaaaccgtaccgtaaaccggttcgggtaaccccgtttacccggttaacgtttaaccggtttttaccgggaacccgggttaaaacgggggaacccgtaaaaccgggtggttaaaccggggaagtaaaccgtaaccggtaaaacccgggttagtaacggggtacggtccgttacggaccctaaccggttacttaccgtttccgg

SEQ ID NO: 392297 - DNA, 662 bp, Homo sapiens
  misc_feature: GZ8MTXP02HEKWE.39.81.H04.1.454.CMB.2.raw
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctaggttactaccctttacaactatggtatcgaggttgggtgcgacacggcccctggtaccaagggtcttggagtggagtgggagtggatcgagtcgtcttaacgagtcggtacaaccaaacgtaaactatacgaccctaacgaacgtaaccctaccgagggaccaagtacgtaccaaaccgagtaccgaccaacaagacaacgacacccgaacgacgaccgacgacctaaccagtacgaccgtagacggacgccgtagacgtacgttcgacggaccggaaccgaccgggtaccgttaggttaaacttcgtacggtcggacggaaacggtaggtaacgggtacggggttaaattacggtttacgacgttaccgggtacccttgttacgacgttacgggtcggggacctacggggtaaccttccgg

SEQ ID NO: 392298 - DNA, 720 bp, Homo sapiens
  misc_feature: GZ8MTXP02IJSA1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaaggccgtggggcctcgagtgaacggtctccgtgactaaggtctttcgttacggttaccttaacccgttttaaccaacttagttagggttacttcgtaggttggggtcgacgacgacggtccccgtaggaacgaaggtcgttaggaggtggagtagggtagtggatccgagtcgtaacgttaactaagtcggaaccaacaaactaaacgtagtacgaccaaaccgtacgaacccgtaccggaaggtaccaaggtacgtacccaaaccagtaaccgaacccgaacgaacaacccaacaccaacccgacgacgtacccgacccggtacctaacgtacgacggtaacgaggacggacgccgtagacgtactcggtaacgacccgtaacgtaccggtacgttacttagttcggtagtacggacgtaaggtaagggtacggttaacgggttaaatttcgttacggtacgtttccgttaaccgttgtaacggtacgtacggaccggacgtaaccggtaccttccgg

SEQ ID NO: 392299 - DNA, 706 bp, Homo sapiens
  misc_feature: GZ8MTXP02IZLHE.39.81.H04.1.454.CMB.2.raw
  modified_base (237)..(237): a, c, t, g, unknown or other
  modified_base (271)..(271): a, c, t, g, unknown or other
  modified_base (358)..(358): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtctctgcaggtcttntggttacacctttacatatggtatcgagttgggngcgacgacggccctggacgaaggtctggagtggagtgggatggatcgagcgtacttaacaagttcggtacaaaccgaactaaaactntacgaccctaaccgacgaacccctacggaaggacctaaggcgtaccaaccgacgtacgaacccaagacgtaaccacactacccgaacgacgacccaccggtacctaccgagtcgggaacctgggaacgacgtcctaggaacgtcgttaccgagggaacccgaccgtaccgggtacggttagttaaacgttcgtaggtggaaccggtaaaggtacggtaaacgggttaacgggttaaaacttttaggttttaccgaaaccgttcccgggttttaacccctttaaggtttaccggtaacggtttaaccgggtccgggggtaacccgtaaccgggttacccggtttaccgg

SEQ ID NO: 392300 - DNA, 624 bp, Homo sapiens
  misc_feature: GZ8MTXP02G0YOG.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagagccaggccaatctcaaggcacctaatttataaggtttcaaccgggactcgtggggtcccagacagacttcagcgcaggtggtcaggcactgaaattcaacactagaaaatcagcgaggggtggaggcgtaggaggagttgggtttaggggtttaattacgttgacagtgacgtaaagggaacacgtacgtacggacccgtaccgttaccgtaaccgttttacgggacccgtaaacgggggaacccgtaaaacggtccggttagggaaacgtaaacgttaaccgaaaaaccggtaaaccgttaaggttaacggggtccttacgggacccaaacccgtaacttccgtttaacg

SEQ ID NO: 392301 - DNA, 660 bp, Homo sapiens
  misc_feature: GZ8MTXP02F0DA0.39.81.H04.1.454.CMB.2.raw
  modified_base (432)..(432): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtacaaagcctacgtatactattgataggaaactacctattagtaattggttacagcagacggccaggccaatcacaggcgtacttaagtttataaggtttccaaccggtctcgtcgggtaccagacagtactcgagcggtcgaggttcggggtcacggactacgtacgtaattcaactactaagaaactcgaagacggagggtgggaggngttaggaggtagttagggttaggggtttacttacggtgtacgtagtacggtagaaaacggaaccaccgtacggttccggtacccgttacccggttaaccgtttaccggttttacgggacccgggtaaccgggggaaacctaacgggtaccgttagggaaacgtaacggtaaccgtaaaacggtaacggttacggtacggtaccgtacgaccggtaacctatttcccgg

SEQ ID NO: 392302 - DNA, 707 bp, Homo sapiens
  misc_feature: GZ8MTXP02FG6EE.39.81.H04.1.454.CMB.2.raw
  modified_base (192)..(192): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttctggtggcagcaacaacaggtgcccactcccaggttcagctggtacagtctggagctnagatgacgaagcctgggcctcagtgaaggtctcctgcaaggcttctggttaccacctttaccaacttatggtatcgaggttgggtcgcgacacggcccctgggaaccgaagggtcttggacgtggagttggggatggactcagtccgtacttaacaagtcggtacaaccaacaactgtcgcccacacgaaccctcgaggggacctaggctccaccgatacgaaccacgacaacacactacccgaacgacgaccgtaccgacctaacgacgtacggacccgagggacggacgcccgtagacgtagtccgaggaccgtacccgtaccgggtcccgttagtttaaactacgtcggtacgaacggaaggtaaacgtaacggttaaaacgggggttaaaactttacggttttaccgtaaccgttacccggggtttaaaccccttcgtttaacgggtaaacccgttaccggggtttaccgggggaacccgtaaaacccggggttcccccgtttaaccgggg

SEQ ID NO: 392303 - DNA, 666 bp, Homo sapiens
  misc_feature: GZ8MTXP02F88KF.39.81.H04.1.454.CMB.2.raw
  modified_base (560)..(560): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacctttaccaactatggtatcgagttgggtgcgacgacggcccctggaccaagggtcttaggagtggagtgggatggatcagcgtacttacaagttggtacaacaacaaaactgtacgaccaacaacgtaacccgtccgaaggggaccaaggaccggttaccaaaccgtaactacgaacccaaacgacgaaccaaaccgactaacccgaacggaacgaccgaacccgggtaccctaacgagtacgggacctagacggaacgtccgaggagacttacgacggaccgaccgtacggtccgttagttacgttacgnggtacgacggaagacggtaggtacggggttaaaattgtttacgacgttcggttacccttgtttacgaccgttacggtcggggtaccgaacggggtaccctaccggg

SEQ ID NO: 392304 - DNA, 703 bp, Homo sapiens
  misc_feature: GZ8MTXP02IUN2K.39.81.H04.1.454.CMB.2.raw
  modified_base (274)..(274): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacacctttacaactatggtatcagttgggtncgacacggcccctggacgaagggcttggaggtggagtgggatggatcgaggcgtacttaacaagtggtacaacaacaaactatcggacccaacgaacgaaccctccgagggccaagcgtacaccatcgacccaacacgacaacactacccgacgagaccgaaccggacctaaccgagttacgggaaccctagggaacggacgtaccgttaggagtacttaccggaggaacccgcggtaccggtaccggttacgttacgtttacgtaggtcggaccggtaaggacgggttaaagggttaaaccgggggttaaaattttacggtttttacggaaccgtttacccggggtttaccctttaacgtttaccggtaaacgtttaaccggggtccgggggtaaccctaaccgggggttaaacccccgtttccgggg

SEQ ID NO: 392305 - DNA, 614 bp, Homo sapiens
  misc_feature: GZ8MTXP02HC2JT.39.81.H04.1.454.CMB.2.raw
  modified_base (164)..(164): a, c, t, g, unknown or other
  modified_base (372)..(372): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtcnccagtctccctgcccgtcacccttggacacgccggcctccatctcctgccaggtctagtcaaagcctacgtatacattgataggaaacacctatgtaattgttcagcagaggtccaggaccaatcaccaaagggctaacccttaatttacgtaaaggtttcgaaacccgggtacttcgtaggggtccccagtacagacttcaagcganaggttcggacagggcactagtaagttccaaactaacgttacaaaaatcaagagaggtaggagagtagaggtagtaggttagggtttagttaagtgtacgtagtagagaacgggaacgaaacgtactaacggcctaccgtacgtacgtttacgtacgaacgggacgaacgtacgtacggaacgaagtaactaaaaccgaaacgtaacgttacggtaacgtacgtaacgaacgtacgtacgtcg

SEQ ID NO: 392306 - DNA, 575 bp, Homo sapiens
  misc_feature: GZ8MTXP02GY8MW.39.81.H04.1.454.CMB.2.raw
  modified_base (331)..(331): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtgggatgttgtgatgactcagtctccagtcctccctgcccgtcacccttggacagccgcctcatctctgcaggtctagtacaagcctagtatacattgatacgaaactcttattgaattggttacagcagacgcagccaatcacgagctactaattatagttcacggctcgtggtccagcagatccgagcgnaggtcggtacaggctactaggtaacttccaacgtaactagaaaactcgagacggtagggtaggaggtcgtaggaggttagttgggtttagggtttatacgtgactagtacggaacgaacggaacacgtacgtcggtacccgttacgtacgtacgtttacgggaccgtaacgggaacacggtagtacggaaagtacgtaacgaaaacgtacgtaggtgactacgactacgtactcgttacgttac

SEQ ID NO: 392307 - DNA, 645 bp, Homo sapiens
  misc_feature: GZ8MTXP02IJJLD.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgcaggcccctggacaagggctgaggtggagtggggatggatcagcgtcttacaagtggtcaacaacaaactatgaccacagaaccctcgaggggcagcgtcacatcgaccacacgacacatacccgaacgacgtaccgaacccggtccctaacacgttacgggaccctagggaacggacgacccgtaggaacgagtcgtacggaaccgaaccgtaccgggccggttagttaacgtttacgtagtcggacggacgggtaggtacggttaaccgggggttaaaattacggtttttacggaaccgttcgggttaacccttcgtttacggtaacgttacggtacgggggaccgtacggggtaacccgttcggg

SEQ ID NO: 392308 - DNA, 702 bp, Homo sapiens
  misc_feature: GZ8MTXP02INKFE.39.81.H04.1.454.CMB.2.raw
  modified_base (400)..(400): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtccaggatccagtggggatgttgtgatgactcagtctccagtcctccctgccccgtcacccttggacacggcccggcctccatcctcctgctaggtctagtacaaacgccttacgtatactattagatacggaaacctaccttattagtaattggttcagcaggacgccaggaccaatcctccgaaggtcgaccttaattttaagtaacggtttaccgtaaccgggtacttcggtcggggtacccagacagtactcgagcggacaggtcggcngggtcacgtagtaacttccgaactagtaaacgaaaactcgaacggtacgtagggggtaggacgggtacgtagggggtaaggttaggtttgggtttaagggtttaacttacggtgtacgtaggttacggaaacgtaaacgggtaaaccacgtaccggtacgggtaccccttacggttacccgtttacggtttacgggacccggtaaaacgggggtacccaaaggggtccgtaaaggaacgttacgtaaaaccgaacggtaacgttggccggtactacgtacctaacccggtttcttaccgtcg

SEQ ID NO: 392309 - DNA, 678 bp, Homo sapiens
  misc_feature: GZ8MTXP02HH6RY.39.81.H04.1.454.CMB.2.raw
  modified_base (669)..(669): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcaggtctagtacaaagcctgtatacattgataggaaactacctacttagtaattggttacagcaggaggccaggccaatcctaccgaaggcctacctttaaatttaagtaaacggtttccgtaaaccgggtactacggtcggggtacccaaggtacacggtacttacgaggcggtacgtagggttcggggtcaacggggtactaaacgttaggtaaacctttacaaaccgtaaacgtaaagtaaaaactcgaacggacgggtaagggggtcgggaagggtcgtaggggtaagggttagttaggggtttagggggtttaattaacgttggactaaggtacgaacgaaaggtaaacacgtacgtaccgggtaccttaccgtacgtacggtttccggacggtacgggaacgtacgacgtaggacgactaacgaaacgaacgtggacgtacgcgtacncgtaactcg

SEQ ID NO: 392310 - DNA, 616 bp, Homo sapiens
  misc_feature: GZ8MTXP02GVEQH.39.81.H04.1.454.CMB.2.raw
  modified_base (352)..(352): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacacggcccctggacaagggcttgagtggatgggatggatcgagcgtacttacaagtggtacaacgaacaaaatntgccacagaacctccgagggcaagcgtcaccatcgaccacagacaacactaccacgagaccgacggaccctacacgtacgggacctacgagggaacgccgtaggaacgtactacgtacggaccgaaccgaccgggtaccgtaggttaacttacgtgtacgcggaagagaaggtacgggggtaaattagtttacggaacttacggttacccttaacgtttacgaacgttacggtacggggaccgtaacggggtacccttaccggg

SEQ ID NO: 392311 - DNA, 637 bp, Homo sapiens
  misc_feature: GZ8MTXP02GA9S2.39.81.H04.1.454.CMB.2.raw
  modified_base (395)..(395): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggggtgcgacaggcccctggacaagggcttgagtggagtgggatggatcgagcgtacttacaagttggtacaacaacaaaactatcgaccaacagaacctcgagggccagcgtcacagtcgaccanacgacacataccacgacgccgacgcctaacagtacggacctagacgggacgccgtaggaacgtactacgtacggaaccgaaccgtaccgggaccgttaggttaacttaccgtggtacggacggtaaggacggtaaggttaacgggggtaaaatttacggttttacgtaccgttacggtttacccttaacgtttacggaacgttacgggtcggggtacccggtaacggggtaacccgtttcgg

SEQ ID NO: 392312 - DNA, 636 bp, Homo sapiens
  misc_feature: GZ8MTXP02IPYZ4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacacggcccctggacagggcttgagtggatggggatggatcgagcgtcttacaagtggtacaacgaactaaactatcgaccaacaacgaaccctccgaggggccaagcgtaccaaccagtcgaaccacagaccacactccacgagaccacccggaccctacacgtcggaaccctaggacggacgaccctggaacgtactcgtacggaccgaccgacgggtacccgtaggttacttacgtaggtcggacgtaacggaaggaggtaacgggggtaaatttacgttttacgtacgttacggttacccttaacgttttacgacgttacggtcggggtacccgaacggggttaccccgtacggg

SEQ ID NO: 392313 - DNA, 685 bp, Homo sapiens
  misc_feature: GZ8MTXP02JDHZX.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacggtctcctgcaaggtcttcgttgttacctaccttacaactatggtatcgaggttgggtgcgacgacggccccgtaggacgaaggtctggagtggagtggatggatcgagtcgtacttaacgaagttcggtaccaacgaactaaaatagtacaccccaacgaacgtaaccctacggagggacaacgcgtaccgaacagtccgaacccaacgacaacgaacactacccgaacgacgacccgaacccggtacctaccgaaaggtcggacccgtagggaacgtacgcccgttagaaacgtcgtacctacggggaaccaaaccggtcgggaccgttagtttaacgtcgtaggtcggaacgtaagggtacggtagttaacgggtaaatttacggtttcgaacggtttaccgtacccttgttaccggtaaccgtcgggggtacggtacccggtaacggtacccctaggg

SEQ ID NO: 392314 - DNA, 577 bp, Homo sapiens
  misc_feature: GZ8MTXP02FPGRZ.39.81.H04.1.454.CMB.2.raw
  modified_base (463)..(463): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctcagtctccctgcccgtcacccttggacagccggcctccatctcctgcaggtctagtacaaagcctcgtatacattgaatacggaaactacctacttgaatttggttcagcagaggccagcaatcaccgaaggctactaatttagtaacggtttccgaaaccgggcttcgcggggtccagacagatcagcggcaggtgggcagcactagacttcacaatagaaatcgaagcgagggtgaacggctaggaggtagttgggttagggtttactagtgactagtgaacgtaaaggaaccncgtacgtaggtcccttaccgtaacgttacgtttacggaccggtaaggggaaccaaggtcgtaggacgtaacgtaaccgaaaacgtaacgtggtacggcagaccaactgttaccg

SEQ ID NO: 392315 - DNA, 610 bp, Homo sapiens
  misc_feature: GZ8MTXP02IOE4F.39.81.H04.1.454.CMB.2.raw
  modified_base (237)..(237): a, c, t, g, unknown or other
  modified_base (378)..(378): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcagcttntgttacaccttacatatgtatcagtggtgcgacgacggccctggacgaaggtcttgaggtggagtgggatggatcgagcgtattacgaagtggtaccaacaactaatatcgaccacacgaacctcgaggacagcgtcaacntacgaccacgagacacacaccacgacgacacgcctaacgacgtacgaccgtaggagacgccgtagacgtagtcgtaggaacccgacgaccggtcgttagtacttacgtacgtaggacggtaagtacggtaacggacggggttaaaatttggtttacggaccgtttacggttacccttaagtttacggtaacgttacggggtacgggtaccgtaccggggtaacccgttccgg

SEQ ID NO: 392316 - DNA, 589 bp, Homo sapiens
  misc_feature: GZ8MTXP02JVB8M.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtctcctgcaaggcttctggttacacctttacaactatggtatcagttggtgcgacaggcccctggacaagggcttgagtggatgggatggatcgagcgcttacaatggtcaacacaaaactatgccaacagaacctcgagggcagcgtaccacatacgaccacgacgaccacactaccaacgagaccaccggccctaacgacgtcggaacccgtgaacggacgccgtgaagactcgtgaacgaccgacggccgttagtacttacgtgtcgacgtagacgaggtaacgggtaaattacgtttcgaaacgtttcggttaacccttcgtttcgaacttacggacggggtaccacgggtaaccttccggg

SEQ ID NO: 392317 - DNA, 622 bp, Homo sapiens
  misc_feature: GZ8MTXP02FG2XL.39.81.H04.1.454.CMB.2.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctgggacaagggcttgaggtggagtgggatggatcgaggcgcttaacaagtcggtacaacacaaatatgcccaccacgaacctccgagggcagcgtccacatcgaccacagacaacactcccacgagccacggaccctaacagtcggaccctaggacgggacgcccgtaggacgaatccgtaggaacggacccgacgggtcccgttaggttaacttaacgtgtagacggaagtaggtaagtaacgggggttaaaattcgttttacgaacgttcggttaacccttgttacgtaaccgttacgtcgggggtacccgaacggggtaccccttcgggg

SEQ ID NO: 392318 - DNA, 693 bp, Homo sapiens
  misc_feature: GZ8MTXP02GHY3Y.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttactaccttacactatgtatcgaggttgggtgcgacgacggccccgtaggacaagggcttggaggtggagtgggatggatcgagcgtacttaacgaagtcggtacaaccaaactaaaactacgtagacccaaccgaacgtaaaccctccggaaggggaccaaggacgtaccaaacccgaagtaccgaacccaacgaacgaaaccaaacctacgtacccaacggaaccgaccgaaccggaccctaactaaggtacggaaccgttaggacggacgccgtaggacgatacgtacggaacgtaacccggaccggtacccgttaggtttaacgttacgttcggtagacggtaaggaggtaaaggtacggggtaaaatttacgtttacgtacgttacggttaccttaacgtttcgtaacgtaccggtcgggtaccgaaccgggtacccgtttaccgg

SEQ ID NO: 392319 - DNA, 588 bp, Homo sapiens
  misc_feature: GZ8MTXP02HHTRV.39.81.H04.1.454.CMB.2.raw
  modified_base (162)..(162): a, c, t, g, unknown or other
  modified_base (326)..(326): a, c, t, g, unknown or other
  modified_base (393)..(393): a, c, t, g, unknown or other
  modified_base (417)..(417): a, c, t, g, unknown or other
  modified_base (577)..(577): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggattgttgtgatgactnagtctccagtcctccctcgcccgtctacccgttggaccacgcccggtcctccatcctctagcaggtctagtacaaagcctagtatacattagatagaactacttatagtagttgttcagcaggacgcacgacatcacgagctactaattagtagttacgtacgntcgtcggaccagacagtactcagcgagaggttggcaggtctagtacgtatcgaacaataacgaaacncgaggaaggtggggtaggtaacgngtaggtaaggtggtttaggtttaggggttactaggtgacgttagacgacaaaggtaaccagtacgtcggtcccttaacgttaccgttacggtacggacgggtaacggaccgtaggtacgagggaactaacgtaccaaggtaactggtaccgctacgaccncgtactcgttc

SEQ ID NO: 392320 - DNA, 655 bp, Homo sapiens
  misc_feature: GZ8MTXP02FNKZX.39.81.H04.1.454.CMB.2.raw
tcagtcgcactagtcacgaccggtgctcgatttagtagtgtagattcgcggggacccaaaaaccacacccctccttgggaaaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttggtgcgacaggcccctggacaaggcttgagtggatgggatggatcgagcgacttacaagtggtacaacacaaactatgacaccagaacctcgagggcagacgtccaccatcgaccacagacacactaccacgacgccacggccctacagtcggaacctggaacggacgccgtaggacgtactccgacggaaaccggtaccgaccgggtccggttagttaacgtttaaccggtggttacggacgggtaaggaacgggtaacggttaaccgggggttaaaacttttggttttacggaaccgtttaccgggtaaccctttacgtttaaggtaaccgttaccgggtcgggggtaaccctacgggggtaaccccgttcggggttacccc

SEQ ID NO: 392321 - DNA, 764 bp, Homo sapiens
  misc_feature: GZ8MTXP02G47C3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaggtcttcgtggttacctacctttacaacttattggtatcgtaggttggggtgccgacgaccggtccccgtagggaaccgaagggtcttaggagtggagtgggattggatcgagcgtacttaacgaagttcggtacaaaccaaacgtaaacttagtcgaaccctaaaccgaacggtaaaccccctaccggaaggggaccaaacgggtacgtacccaaacctacgtaccgaaccccaacgaaacgaaccaaaccgtacctaacccgacgaacggacccgaacccggtaccctaaacgacggttacgggaaccgtggaaacgggaccgtaccgtaggaacgtaccgtacggtaacgggaacccgaacccgtcgggtacccgttagtttaacgttaccgtggtacgacggtaaggtaaccggttaaaggtaacggggttaaaatttcgtttacggaacgtttaccggttaaccctttcggttaacgtaccggttacgggttaccgggacccgtaaccggggtaacccgtttccgg

SEQ ID NO: 392322 - DNA, 696 bp, Homo sapiens
  misc_feature: GZ8MTXP02HBEDZ.39.81.H04.1.454.CMB.2.raw
  modified_base (363)..(363): a, c, t, g, unknown or other
  modified_base (389)..(389): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtggaaggtctcctgacaaggtctttcgtaggttaacctaccctttaaccaacttagtggtactcgaggttgggtgacgacgacggccccgtaggaaccgaagggtctaggtagtaggagtgggagtggaactcaggcgtacttaanaagttcggtacaaacaaacaaactanacgacccaacgaacgaccgacgaggacaagtacgtaccaactaacgacgaaccaacgaacgaacctaaccaccaccgaacgacgacgtaacccgactaaccacggtaccgaacgtaggacgtacgaccgtaggaacgtacgtacgtacggaaaccgaacggtaccggtaccggttaagttacgtacgtacggagaacggaacggtaggtaacggtaaacggttaaagtttacgttacgtacgttaccggttaccttaacgttacggtaacgttacgggaccgggtaaccggtaacgggtaccctcgg

SEQ ID NO: 392323 - DNA, 550 bp, Homo sapiens
  misc_feature: GZ8MTXP02GR3RK.39.81.H04.1.454.CMB.2.raw
  modified_base (252)..(252): a, c, t, g, unknown or other
  modified_base (272)..(272): a, c, t, g, unknown or other
  modified_base (281)..(281): a, c, t, g, unknown or other
  modified_base (286)..(286): a, c, t, g, unknown or other
  modified_base (304)..(304): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctccatctcctgcaggtctagtcaaagcctcgtatacattgataggaaacncctatgaattgttcagcagngcagcatcncagcnctattatagttcaacggntcgtggtccagacagatcagcgcaggtggtcaggcacgtagaattcaactactagaaaatcgagacgaggggtgaggcgtaggagtagttaggttaggggtttatacgtgacgtagtacgacgtaaaggaaccacgtacgtcggtacccgttaccgtacgttacgtttcggaccgtacggggaaccaaggcgtaggaacgaacgttaacgaaaacgaacgtggtacgactacgacacctattaccg

SEQ ID NO: 392324 - DNA, 720 bp, Homo sapiens
  misc_feature: GZ8MTXP02G2UK2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgacaggtcttctggttacctacctttaccaacttatggtatcgtaggttgggtgacgacgacggccccgtaggaccgaagggtcgttaggaggtagggagtggggagttgggatcgaggtcgtacgtttaacagttcggtaccaaacaaactaaaactatacgaacccctaacgaaccgtaacccctcggaacggggacaagacggtaccaaacctagtacgaacccaacgacgaaccacgaactacccgaaacgacgacccgaaccggtaccctaacgacggtccgggaacccagggaacggacgaccgtaggagtacgttacgacgggaacccgacggtacccggtcgttagtaacttcgtagacggtacggaacggaggtaacggttaacggggttaaatttacggtttacgaccgtttacggttaaccctttcggttacggtaccgttacggggtcgggtacccggtaaccgggtaacccgtttccgg

SEQ ID NO: 392325 - DNA, 687 bp, Homo sapiens
  misc_feature: GZ8MTXP02J1J4A.39.81.H04.1.454.CMB.2.raw
  modified_base (255)..(255): a, c, t, g, unknown or other
  modified_base (269)..(269): a, c, t, g, unknown or other
  modified_base (394)..(394): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctcagtgaaggtctcctgcagcttcgtgttaccacttacaatntggtatgagttggngcgacgacggccctggacaaggtcttaggagtggagtgggatggatcgagcgtacttaacaagtggtacaacaacaaactagtacacccgaacacgacccgtaccgagggacagcgtaccacgancgaaccaacgagaccctacacacccgaacgacgacgacccgaccaacgacgtacggaccgtaggacggacgtccgtaggacgtactcggaaccgtaaccggaccgtaccggggttaccgttaggttaaccttaggtttacgggcggtaacggaggttaacggacgggggttaaacggggttaaaactttgttttaccgggaaccgttttcccgggtttaaacccgttccggtttaacggtaaccggttaccggggttaccgggggaacccgtaccgggtttacccgttcccgg

SEQ ID NO: 392326 - DNA, 594 bp, Homo sapiens
  misc_feature: GZ8MTXP02F4FXN.39.81.H04.1.454.CMB.2.raw
  modified_base (347)..(347): a, c, t, g, unknown or other
  modified_base (373)..(373): a, c, t, g, unknown or other
  modified_base (491)..(491): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggcccctggacaagggcttggagtggagtgggatggatcagcgcttacaatggtacacaacaaactntcgccaacagaaccctcgagggcagngtcaccagtcgaaccacgacgacctaacactacccgacgacgccgtaaccggcctaacagttcggaacctaggacggacgccgtagagatctaggacgacgacggcgtagtacttagngtagcgagtagaggtacgggtaaatttagtttcgaacgttcggttacccttcgtttacgacgttacgggtacggggtaccgaaccggggtacccgtttaccgg

SEQ ID NO: 392327 - DNA, 708 bp, Homo sapiens
  misc_feature: GZ8MTXP02JXJYA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaggtcttcgtgttactacctttaccaactagtggtatcgtaggttgggtgcgacgacggccccgtggacgaaggtcttaggaggtggagtggagtggatcgagtcgtacttaacaagttcggtacaccgaaactaaactagtacgaccccacgaaccgaacctccgacgggacacgacgtaccaaccgatacgaaccacgaacgacactacacccgacgacgaccgaccgacctaacgacgtacggactaggacggacgccgtagacgtagtacgacggaaccgaccgtaccgggtaccgttaggttacttcggtacggtacggacgtaaggtaacggtaaacggttaacgggggttaaaacttttacgtttaccggtaaccgtttacccggtttacccgtttaacggtttaaccggtaaaccggttacgggttaccggggaacccggtaacgggggtaaccccgtttaccgggg

SEQ ID NO: 392328 - DNA, 611 bp, Homo sapiens
  misc_feature: GZ8MTXP02J2I5Z.39.81.H04.1.454.CMB.2.raw
  modified_base (360)..(360): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacctacctttaccaactatggtatcgtaggttgggtgacgacgacggcccctggaccgaagggcttggaggtggagtgggatggatcagcgtcttacaagtggtcacgaacaaactnagaccacacgaaccctcgagggcagtcgcacatcgaccacagacaactacgaccacgacgacgacgcctacgacgttacggaacccgtggaacggacggtccctagagtacttacgcggaacgacgacggttcccgtagttacgttacgtgtacgacggtacgaaggtacggtacggggtaaaatttgtttacgaccgttcgttacccgttgttacgacgtaccggttcggggacctacggggaccttcgg

SEQ ID NO: 392329 - DNA, 702 bp, Homo sapiens
  misc_feature: GZ8MTXP02G5S0Y.39.81.H04.1.454.CMB.2.raw
  modified_base (402)..(402): a, c, t, g, unknown or other
  modified_base (475)..(475): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtggaaggtctcctgcaaggtcttcgtggttacacctttaccaactatggtatcgagtgggtgcgacgcggccccgtggacgaagggtcttgaggtggagtgggagtggactcgagcgtacttaacgagtcgtacaacaaacaactatgacccaacgacgaaccctcgaggcaagcgtaccactanaccgaaccacacgtaacaacctactacccgaacgacgacccgtaacccggacctaacgacgtcggaacccggnggaacggacgcgtaaggacgtacgtaccgtacgggacccgaacggtaccggtacggttaagttacgttacggtagggtacgaacggtaacggaaacgggttaccgggttaaacgggttaaagttttaacgtttacggtacccggtttacggtttaacccttcggtttaaacggaccggtttacggggtaccggggtaaccccggttaaccggggtaacccgttccgg

SEQ ID NO: 392330 - DNA, 699 bp, Homo sapiens
  misc_feature: GZ8MTXP02HKXDL.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtcctccagtcctccctgccccgtcacccttggacacgcccgcctcatctcctgcaggtctagtacaaagtcctacgtatactattgatacggaaactcctactgtaattggttcagctagacgccagccaatccacgaagctaccttaagtttacgtaacggtttacgtaaaccgggtcttcggtacggggtacccaggtactagtacttcgacggcggctaggggttgggccgagggtaacacgttagtaaacctttacgaaacgttaaccgtaagtaaaactccgaaaggacgggtaaggggttaggaaccggttgtaagggaacggttaggttaggggtttaggggtttaacttaacgttggacgtttagtagaaccggaaaacggtaaccaccgtaacggtccggtaacctacccggtttaacgtcggtttaaccggggacccgtacgggggactaaacggtacggtacggaacgtacgttaaacgaaacggtaacgtaggtacggactacggacctaccgttacgtccg

SEQ ID NO: 392331 - DNA, 672 bp, Homo sapiens
  misc_feature: GZ8MTXP02JIRAS.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttacaactatggtatcgtaggttgggtgcgacgacggtcccctaggacgaagggtcttggaggtggagttgggagtggatcgaggtcgtacttaacgaagtcggtacaacaaactaaactatcgacccaacacgaaccctcgagggacaagcgtacaacgtactacgaacccaacgaacgaccaacgtacacccgacgacgaccgaaccgactacgacgtacggacccgtaggacggacgtccgaaggaacgtagtaccgtacgggaaccgaccgaccgggtaccgttagttacgttacgtaggtcgacggtaaggaggtaaacgggtaacgggtaaaatttacggtttacgtaacgttccgttaaccttcgtttacgaaaccgttcgggtacgggacccgtaacgggtaacccgttcggg

SEQ ID NO: 392332 - DNA, 670 bp, Homo sapiens
  misc_feature: GZ8MTXP02IE3TK.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcagttgggtgcgacgacggcccctggaacaagggcttggagtggagtgggagtggatcgagcgtacttacaatggtacaacgtaacaaactagtcacccaacacgaaccctaccgagggccaagacgtccaaccatacgaacccaacaagaaccaactacacccaaacgacgacccgaaccggtacctaaaccgacgtacggaacccgtaggaacggacggaccctagggaataacgttcgtaacgggaccgaaccgttaaccggggtccttaggttaaacttacgttggcggacgagaagtaggtaacgggttaaaattagtttttacgaccggtttacgttaacccgttcgtttacggaaacgttccgggtcgggtaccccgtaacgggtaaccccgtccgg

SEQ ID NO: 392333 - DNA, 710 bp, Homo sapiens
  misc_feature: GZ8MTXP02G30EE.39.81.H04.1.454.CMB.2.raw
  modified_base (302)..(302): a, c, t, g, unknown or other
  modified_base (307)..(307): a, c, t, g, unknown or other
  modified_base (356)..(356): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcaggttgggtgcgacaggcccctggacaggcttgngtggngtggatggatcgagtcgtcttaacaagtggtacaacgaaacaaacttancgaccaacacgaacctcgagggccaagcgtacaaccgagtaccgaaccaacgaacgaaccaacacttacccgaacggacgacccaacccgggtcccaacgaacgttcgggaacccgtggaaacgggtcgtacccgaggacggtaattcccgtacgggaaacccgaacccgtaaaccggggtcccgttaggttaaacgttttccgagggttaccgaacggaagggtaaagtaacgggttaaccgggggtaaaaattttggttttacgaaccggttcccggttaacccgtttaagtttacggtaccgttaacggggtcggggtaacccggtaaccggggtaaccccgtttccgggg

SEQ ID NO: 392334 - DNA, 697 bp, Homo sapiens
  misc_feature: GZ8MTXP02HI2BO.39.81.H04.1.454.CMB.2.raw
  modified_base (275)..(275): a, c, t, g, unknown or other
  modified_base (366)..(366): a, c, t, g, unknown or other
tcagtcgcactagtcacgaccggtgctcgatttagtagtgtagattcgcggggacccaaaaaccacacccctccttgggagaatcccctagatcacagctcctaaccatggactggacctggagcatccttttcttggtggcagcaacaacaggtgcccactcccaggttcagctggtacagtctggagctgagatgacgaagccgtggggcctcagtgaaggtctcctgcaaggtcttcgtgttactaccttaccaactatgtatcgagttggncgacacggccccgtggacaaggcttaggacgtggagtgggatggatcgaggcgtacttaacgaagttcggtaaccaacgaaactaaaactntacggacaacgaaccgtaacctaccggaagggcaaggacgtccaaacagtaccgacccaaacgtaacaaccaacacctacccgaacggacgaccgaccggaccctaacgacgtacggaccgtacggaacgggacgcccgtagaacgtacgttcgaacgaccggaccgacgggtaccgtagttaacttcggtaggtacgagaaggtaacggtaagttaaaccgggggtaaatttacgtttacgggtaccgttacgtttaacccgttcgttaaccggtacggtacccgggtcgggtaaacccggtaaccggtacccggtttaccgtaacccgg

SEQ ID NO: 392335 - DNA, 666 bp, Homo sapiens
  misc_feature: GZ8MTXP02I9GYM.39.81.H04.1.454.CMB.2.raw
  modified_base (362)..(362): a, c, t, g, unknown or other
  modified_base (374)..(374): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgcccgtcacccttggacacgcccggcctccatcctcctagcaggtctagtacaaagcctagtatactatgataggaaactccttatgaattggttacagcagagccagccaatcacgaaggccacttaatttagtaaggtttccaaaccgggtctcgtcgggtcccaagactagacttcaggcggnaggtgggtaccngggctacgtagaacttccgaacactaagaaatcgaagacgtaggggtagaggtcgtaggaaggtacgtttgggttacgggtttattacgtgtacgaacgttggaacgtaacgggaaacaaccgtacgtaccggtcccttaaccggttacttaaccggtttacgggacccggttaaacgggggaacccgtaaaggtccggttaaagggaaccgtaaacgtaaaccggtaaaacggtaaccggtttaaggacggtaccgttaccggaacctaacctacggttcctttaacccgg

SEQ ID NO: 392336 - DNA, 801 bp, Homo sapiens
  misc_feature: GZ8MTXP02FS48C.39.81.H04.1.454.CMB.2.raw
  modified_base (610)..(610): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctggagatggacggaacggccggtcggggccttacgaggttaggaacggttccttcccgtaggaccgtaaaggtcctttcgttacggttaacctaacccgttttaaccaaacttagttaggttatacggtaggtttggggtacgaccgaaccgacccggtccccgtagggaaccggtaacggggtcttagggaggtaggaggtaggggacgtagggtaacttacgacggccgttaacttaacgtaacggttccggaacctaaacgtaaacctaaacgtagtacgaaccgaaacccgaaccgtaacccgtaccggaagggacctaagaccgtccaaacgaacgtacgaacccaacgtaacaaaccacttacgacccgaaacggactacccgaaccgaccaaagtacgtaccgggacacggngggtaacctcgaaggaactctcgaaacggaccgtacccggacgtttcgtagtttaacgttaccggaggtacggagtaaacggtaggtaaacggttaaacgggttaaattttacgttcggtaaccgttccgttaccgttaacgttacggaaccggttaccggggaccggtaaccgtaccgggtttacccacg

SEQ ID NO: 392337 - DNA, 666 bp, Homo sapiens
  misc_feature: GZ8MTXP02H23SX.39.81.H04.1.454.CMB.2.raw
  modified_base (237)..(237): a, c, t, g, unknown or other
  modified_base (256)..(256): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgagtctcctgcaaggtcttntggtactaccttacaactntgtatcgaggttgggtgcgacacggccctggacaagggcttggagtggagtgggatggatcgagcgtacttaacgaagtcggtacaacaacgtaaactagtacgacccaacgaaccgtaacccgtaccggaggggaccaacggtacgtaccaaacccgagtaccgaacccaacgaacgaccaaccgaactacccgaacgaacgacccgaacccggtaccctaacgacgttacggaaccgtaggaacggacgtaccgtagaaggtactaccgtacggaaccgaaccgcgggtaccgttaggttaacttacgtgtaggacgaggtaggtaaaggtaacgggtaaattacgtttacgacgttaccgtaccttgttacgacgttaccggcgggacccgtacggtaacccgtcgg

SEQ ID NO: 392338 - DNA, 600 bp, Homo sapiens
  misc_feature: GZ8MTXP02HG07V.39.81.H04.1.454.CMB.2.raw
  modified_base (251)..(251): a, c, t, g, unknown or other
  modified_base (263)..(263): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatctcctgcaggtctagtcaaagcctcgtatacattgatggaaacnctatgattgttnagcagagccaggccaatctccaagcgacctaattataaggttcaaccgggtctcgtcgggtacccagacagacttcagcggacaggtggtcaggcacgtagaacttcgaacacttagaaaatcgaagacgaggggtaggaggtcgtggaaggtagttagggtttaggggtttaattaacgtgtactagttagacgtaaagggaaccaacgacgtacggtaccttaccgtacgttacgtttacgggacccgtaacggggacctaaggtccgtaggaacgtacgtaacgaaaacgtaacgtggtacggtacctacggaccaccgtacgttcgtttaccg

SEQ ID NO: 392339 - DNA, 622 bp, Homo sapiens
  misc_feature: GZ8MTXP02GWH5J.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacacctttacatatgtatcagttggtgcgacaggcccctggacaagggcttggagtggagtgggatggatcgagcgtacttaacaagtggtacaacgaacaaactatcgaccacacgaacctcgagggcaagacgtacaactataccgacccaagacgaccaacaactaccgaacgacggaccacccggtaccctacacgtacggacctagggaaggtaccgccgtaggaacgctacgtacggaaccgaccgaccggtccgtagttaacttacgtagtcggacgagtacggaggtacggtaaagttacgtttacgacgttacgttacccgttaagtttcggaactacggtaccggggacgtaccgggtaccgttaccgg

SEQ ID NO: 392340 - DNA, 551 bp, Homo sapiens
  misc_feature: GZ8MTXP02FOIKK.39.81.H04.1.454.CMB.2.raw
  modified_base (360)..(360): a, c, t, g, unknown or other
  modified_base (376)..(376): a, c, t, g, unknown or other
  modified_base (421)..(421): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtgtcagcaacaacaggtgcccactcccaggttcagctggtacagtctggagctgagatgacgaagcctggggcctcagtgaaggtctctgcaaggcttctggttacaccttacaactatggtatcagttggtgcgacaggccccgtggacaagggctgagtggatggggatggatcagcgcttacatggtcacacaaactatcgacacagaacctcaggcnggactcacatgaccanacgacacatccacgagcacgactacatgacctgagacgcctaganatcgacgacgacgacggtccgtagtacgtacgtgtcgacgaggagtacggtaacggggtaaattacgtttacgacgttcggtaacccgttgttacgtacgtacggtacggggaccgttacgggtaacccg

SEQ ID NO: 392341 - DNA, 733 bp, Homo sapiens
  misc_feature: GZ8MTXP02G5GFM.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcgaaggtcttcgtgttacctacctttaccaactatgtatcgtaggttgggtgccgacgaccggcccgtggacgaagggcttggaggtggagtggggtagtggtacgtcgaggtcgtactttaacgaagttcggtacaaactaacctaaactataccgacacgaacgaacccgtcgaagggcaggacgtaccgaaccacgtacgaacccaacgacgaaacctacaccctaccgaacggacaccgtaccggaccctaacgagtacggacccgtagggaacggacgtaccgtagggatacgttcccggaagaaccccggacggtccggtaccgttaagttacgttaccgtggacggacggtaaaggaggtaacgggtttaaccgggtaaaagttttacgtttacggggtaacccgtttaccggtttccccgtttagtttaaacccgggtttacggggttacccggtacccgggggtaaccccgttaacgggggttaacccccgg

SEQ ID NO: 392342 - DNA, 630 bp, Homo sapiens
  misc_feature: GZ8MTXP02HC6Z3.39.81.H04.1.454.CMB.2.raw
  modified_base (368)..(368): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacctacctttaccaactatggtatcagttgggtgcgacacggcccctggacgaagggctaggaggtggagtgggagtggatcgagcggtacttaacgaagtggtacaacgaacaaaactanaccgacaacacgaacccgtacgacgggacaggacgtaccaacctagtacgaaccacgaaacgaccaccactacccgacggacgaccgaccggacctacaagtcgaccgtggacggactccgtagagctacgtagaacgtaccggacggtaccgttagtacgttacgtgtaccggacgaggagttacggaggtaaatttacgttacgcgttacggttccttacgttacgtaccgtacggtcgggtaccggaccggtaacccgg

SEQ ID NO: 392343 - DNA, 760 bp, Homo sapiens
  misc_feature: GZ8MTXP02GVJYG.39.81.H04.1.454.CMB.2.raw
  modified_base (221)..(221): a, c, t, g, unknown or other
  modified_base (455)..(455): a, c, t, g, unknown or other
tcagtcgcactagtcacgaccggtgctcgatttagtagtgtagattcgcggggactgatcaggactcctcagttcaccttctcacaatgaggctccctgctcagctccgtggggctgctaatgctctgggtcccaggatccagtggggatgttgtgatgactcagtctccagtcctccctcgcccgtcacccgttggacacgcccggcctccatcctccgngcgaggtctagtacaaacgtcctcgtaatacattgatacggaacactacttgaattggttacagcaggacggccaggaccaatccgtacgaacggtacctactttaaatttacgttaacggtttaccgtaaccgggtcttcggtcggggtacccaagtacacgtactacgaggtcggtacgtaggttcgggtcgacgggactaaccgtagtaaacttacgaactaacgttaaanaaaacttcggaagccggtaaagggggtgaacgtcggtaggaagggttaggtttggggtttaaacgggtttttatacgtacggtacgtagtacgggtaaccgtaaacgggtaacaccgttaccgggtaccggttaccccgtttaacccggttaaccgtttaccgggtttacccgggaaacccggggttaacggggaaacccttaacgggtacccggtaaagggggtaacctaaacggtaacccgtaaaaccgggtgttacggtacgggtacccttaccgaaccgttaacccgtttagtttacccgg

SEQ ID NO: 392344 - DNA, 653 bp, Homo sapiens
  misc_feature: GZ8MTXP02G26F0.39.81.H04.1.454.CMB.2.raw
  modified_base (271)..(271): a, c, t, g, unknown or other
  modified_base (379)..(379): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctcctgcaaggcttctggttacacctttacaactatggtatcagttggngcgacaggcccctggacaagggcttgagtggatgggatggatcgagcgcttacaagtggtcacaacaaactatgccacagaacctcgaggcagcgtcacatcgaccanacgacacatcccaacgagcacgcctaacacgtcggaacctgaacgggtacgcccgtaggacggtaacttcgtacgggaaaccgaaccgtacccgggaccggttaggttaaacctttaacgtggtacggaaccggtaagggaaacggttaaggtaaaccgggggtaaaattttacgttttagggaacctttacgggttaaccccgtttaaccgtttttaggaaccgtttaccggacgggggtacccctaacgggggttaaacccgtttaccgggg

SEQ ID NO: 392345 - DNA, 731 bp, Homo sapiens
  misc_feature: GZ8MTXP02FPYI7.39.81.H04.1.454.CMB.2.raw
  modified_base (286)..(286): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctggttactacctttaccaacttatggtatcgtaggttgggtgcgacncggcccgtggacgaagggcttggagtggagtgggatggatcgaggtcgtacttaacaagtcggtacaacaacaaatatcgaccacgacgaaccctcgacgggacaaggcgtaccaaccataccgaaccaacgaaacgacaaaccgactacccgaacggaacgacccgtaccggaccctaaccgacgttacgggaacccgtagggaacgggtacgtacccgtaggactaactttccggagggaacccgaaccggaaccggggtccgtaagtttacgttaacggtgggtacgacggaaaggtagtaaagggttaaccggggtaaaatttttcggtttaacggtaaccggtttcgggtttaaccccctttaagttttaaacccgggtaccgttaacccggggttccgggggtaacccggtaaaccggggttaacccggtttacccggg

SEQ ID NO: 392346 - DNA, 567 bp, Homo sapiens
  misc_feature: GZ8MTXP02H18ZQ.39.81.H04.1.454.CMB.2.raw
  modified_base (374)..(374): a, c, t, g, unknown or other
  modified_base (393)..(393): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgccccgtcacccttggacagccggcctccatctcctgcaggtctagtcaaagcctcgtatacattgataggaaaactacttacttgaattggtttcagcagaggccaggccaatctccaaggcgaccttaaatttataaggtttcctaacccgggtactcgtggggtaccccagacagtacttcagcgcaggtggtcnggcactgaattcacactanaaaatcaagcgagggtggagcgtaggaggtagttgggtttagggttattacgtggacagttgacgtaaggacaacgcgtacgccttaccgtactacgtttcggaccgtacgggacaagcgtaggacacgtaacgaaacgaactggtcgacgtacggacctaacgcttcgttccg

SEQ ID NO: 392347 - DNA, 586 bp, Homo sapiens
  misc_feature: GZ8MTXP02FHTGJ.39.81.H04.1.454.CMB.2.raw
  modified_base (376)..(376): a, c, t, g, unknown or other
  modified_base (411)..(411): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacaactatgtatcgagttggtgcgacacggcccctggaacaaggctgagtggagtgggatggatcgacgcgtcttaacgaagtggtacaaacaacaaaactatgaccacacgaactccgaggcagngccacatacgaccacgagacacactacccacgacncgaacgcccaacgagtacggacctacggaggaacgcctagacgtatcgacggaacgacgaccggtccgttagtacttacggtgtacggacgagacggaggtaacgggtaaattgtttacgacgtcggttaaccctgttacgtacgtacggtcgggaccgtacgggacccttacgg

SEQ ID NO: 392348 - DNA, 597 bp, Homo sapiens
  misc_feature: GZ8MTXP02FJYHR.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccttggacacgcccggcctccatctcctgcaggtctagtcaaagcctgtatacattgataggaaacacctattgaattggttcagcagaggccaggccaatctaccaaggctaccttaaatttataacggtttcgaaccgggtactcgtcggggaccagacagtattcgagcggacaggtcgggtcagggctacgtagtaacttcgaacactaagaaaatcgagacgaggggtaggaggcgtaggagggtagttagggtttaggggtttaattacgtgacgtagtgaacgtaaaggaaccacgacgtacggtacctaccgtacgttacgtttacggaccggacggggaccaacggtcgtaggacgtaacgtacgaaacgtaacgtgtacgactacgaccacctacgtcg

SEQ ID NO: 392349 - DNA, 657 bp, Homo sapiens
  misc_feature: GZ8MTXP02JLIUB.39.81.H04.1.454.CMB.2.raw
  modified_base (483)..(483): a, c, t, g, unknown or other
  modified_base (537)..(537): a, c, t, g, unknown or other
  modified_base (545)..(545): a, c, t, g, unknown or other
  modified_base (579)..(579): a, c, t, g, unknown or other
  modified_base (584)..(584): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctgttaactaccctttaaccaattataggtatcgtaaggtttggggagccgtacgacggtccccctagggaacgaacgggtctttaggaggttaggagtgggaagttgggaaatccgaaggccgtactttaaacgaagttcggacaaaccaaacgtaaactatacgacccaaccgaacggaaacccctaccggaagggccttaagaccgtccaaacacgacgaaccaacgaacgactaaacgtanacccgaaacgagtccgaaccgtactaccaagccgggtacaggaacgacccgttnggaaactncgacggacgaccgtacggcttaggtaacttcggngacgngaacgtagtaggtaacgtaaattgttacgacgttcgtaactgtacgacgtacggcggtaaccgacggtacctg

SEQ ID NO: 392350 - DNA, 692 bp, Homo sapiens
  misc_feature: GZ8MTXP02J2JS4.39.81.H04.1.454.CMB.2.raw
  modified_base (396)..(396): a, c, t, g, unknown or other
  modified_base (517)..(517): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgcccgtcacccgttggacacgccggcctccatctcctgcaggtctagtacaaacgcctagtatacattgatacggaaactcctattgaattggttacagcaggacggtccaggacctaatccgtaccgaaggcctacctttaaatttaacgttaacggtttccgtaaaccgggtctacgtcggggtacccaagacctaggtacttccgaggaccggnaggtcgggtcagggtccagtagtaacttccaaactactaagaaaacgtcgaggtacggaagggggtcggagggtcgtaaggggaagggttacgtttaggggtttaggggtttaatttacgngtagtagtacggaaggaaacgaactacgtacgtacggtcccttaccgtaacgtttaccgggtttccggaccgggaaacggggtaacccgtaggtacggttaacgggaacgttaaacgaacccgtaaaaccggtgttacgggtaacgtccgtacggtacccacgtttacgttcccg

SEQ ID NO: 392351 - DNA, 674 bp, Homo sapiens
  misc_feature: GZ8MTXP02HPUQ7.39.81.H04.1.454.CMB.2.raw
  modified_base (658)..(658): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtcctccctcgccccgtcacccgttggaccacgcccggcctccatcctcctgcaggtctagtacaaagcctagtatacattgataggaaactacctattgtaattggttacagcgaggacgccgaggaccaatcctaccgaaggcctaacctttaaagtttaacgttaaacggtttccgtaaaccgggtacttcggtacggggtaccccaggactacgtacgttcgacgtcgggcgtaggggtgggtccgacgggtactacgtagtaaacttcccgaaataacccgtaagtaaaactcgtacggtacggaggggttacggaggtcgtaggtaagggttagttagggtttagggtttacttacgtgacgttagacggtaacgaaacgtaaccaacgtaccgtacggtccttaccgttaccgttacgtttaccgggacggtaacggaccagtcgtaggacgactaacgaaacgtaacgtcgacggctanacctacgtactttccg

SEQ ID NO: 392352 - DNA, 713 bp, Homo sapiens
  misc_feature: GZ8MTXP02ILUHH.39.81.H04.1.454.CMB.2.raw
  modified_base (434)..(434): a, c, t, g, unknown or other
  modified_base (494)..(494): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtgggcctcaggtgaagtctccgtgacaaggtcttcgtggttaacctacctttaaccaacttagtggttatacgtaggttggggtgcgacgacggccccgtaggacgaagggtctttggaggtaggtagtggggatagggatcgaggccgtacgttaacgaagtcggtaacacgaaacctaaatagtcgacccaacaacgaccctacggagggacaagcgtacaacacnccgaaccacaacgtacaactacaccacgacgaccgaacccgctaacgaggtacgtaccgnggaacggctaccgtagacgtacgtacgtacggaacccggtacgaccccggtaggttacgtacgtttagtcggtaacggacgtaaagggacggttaaaggggtaaaccgggttaaatttacggtttacggtaaccgtttaccggtttcctttaaccggttagtaaccgggttacccgggtacggggtacccggtaaacccgggttaacccgtttcccggg

SEQ ID NO: 392353 - DNA, 674 bp, Homo sapiens
  misc_feature: GZ8MTXP02H5KTA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggaatggaccctggagcatccttttcttggtggcagcaacaacaggtgcccactcccaggttcagctggtacagtctggagctggagatgacgaagccgtggggcctcagtgaaggtctcctgcaaggtcttctggttacctaccttaccaactatggtatgagttgggtgcgacgacggcccctaggaccaagggtcttggagtggagtggagtcggatcgagcgtcttaacaagttggacaccaacgaaaactagtacgaccaaccgtaacggaaccccctaccggaaggggaccaacgtaggttacccaacccgaacgtaccgaaaccccaaccgaagaaccaaccaccgacccaaccgaacgcccgaaaccgggtacccttaacgacgtaccggacccgtagggacggacgccgttaggactcgtacgtcggacgaccgacggtacgttgtaacttcgagtcgtacgaagacgtaaggtacgggtaaatttagtttcgacgttccggttaacccttcgttacgtaccgttcggtacgggaccgtacgggtaacccgtccgg

SEQ ID NO: 392354 - DNA, 681 bp, Homo sapiens
  misc_feature: GZ8MTXP02FJE09.39.81.H04.1.454.CMB.2.raw
  modified_base (275)..(275): a, c, t, g, unknown or other
  modified_base (355)..(355): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacacggcccctggacaagggcttgagtggatgggatggatcgagcgtcttaacaaagtggtacaaacgaacaaaactntacgaccaaccgaagaaaccctccgaaggggccaaggtacgtccaaccaatacgaacccaacacgacaacatcccaacgagacctaaccgggaccctaacgatacgggacctaggacggacgaccgttaggacgaagttccgacggaaccggaacccgaaccgggggtcccgttaggtttaactttaaccgtagggttcggaaccgggtaggaaaggtaacggttaaaccgggggtaaaaactttagtttttacggaccttacggttaaaccccttgtttacgaacgttacggtcgggggacctaaccgggggaacccctttcggg

SEQ ID NO: 392355 - DNA, 707 bp, Homo sapiens
  misc_feature: GZ8MTXP02F7THY.39.81.H04.1.454.CMB.2.raw
  modified_base (334)..(334): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcaggttgggtgcgacaggtccctggaacaagggtcttggagtggagtgggatggatcagcgtacttanaagtggtcaacaacaaaactatgacccaacgaacgaaaccctccgaacggggaccaaggtacggtacccaacccgtaaagttaccggaaacccaaaccgaaacgaaacccaaaccaacctaacccgaaaccggaacggacccgaacccgggtacccctaacgaacgttacggggaacccttagggaacgggacgacccgtaggacggtactccgtacggaccgaaccgacggccgttaggtacttagcggtagacgaaggtaggaaggttacggggtaaatttagtttacggtaaccgttcggtttaaaccccttcgtttacggtaaccgttacggtaccgggggtacccgaacgggggttacccctaccggg

SEQ ID NO: 392356 - DNA, 631 bp, Homo sapiens
  misc_feature: GZ8MTXP02FH3TS.39.81.H04.1.454.CMB.2.raw
  modified_base (260)..(260): a, c, t, g, unknown or other
  modified_base (406)..(406): a, c, t, g, unknown or other
  modified_base (518)..(518): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactntggtatcagttggtgcgacacggccctggacgaagggcttaggagtggagtgggatggatcagcgtcttaacaagtggtacaacaacaaaactgtagaccctaacgacgaaccctccgagggcaggtacgtccaccatcgaaccanacgaacaccactacccaacgacgccaaccggaccctaacgacgtacggacctaggaacggacgccgtagacgactcgtacggaccgaccgaccggccgttagttacttacgngtacggacggaaggacggtaagggttaacgggtaaaatttcgtttacggaccgttacggtttacccttgtttacgacgtacggtcggggacccgtaacgggggacccttacgg

SEQ ID NO: 392357 - DNA, 623 bp, Homo sapiens
  misc_feature: GZ8MTXP02IFMM5.39.81.H04.1.454.CMB.2.raw
  modified_base (384)..(384): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctaggaccaagggcttggagtggatgggatggatcagcgacttacaatggtacacaacaaactatgaccacagacctcagggcagcgtcacatcgaccanagacatacaccacgacgacaaccggcctaacacgtacgggaaccctaggaacgggacgcccgttagaaggtaacttccgaagaaccgacgaaccgggtcccgttagtaacgttacgtcgtagacggtaaggacgaagttacgggggtaaaattacgtttttacgacgtttcggttaccccttaagtttacggtaacgtaaccggtcgggggtaccctaacggggtaaaccccgttcggg

SEQ ID NO: 392358 - DNA, 802 bp, Homo sapiens
  misc_feature: GZ8MTXP02I8UMY.39.81.H04.1.454.CMB.2.raw
  modified_base (239)..(239): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttntggttaccacctttaccaactatggtatcgaggttggtgcgacgaggcccctggacagggcttggagtggatggggatggatcgaggtcgtacttaacgaagtaggaaaacaacgtaaaagtagtacgaccgtaactaacgtttaaacgtttcccgaagggggtacctaagggtacggtaccctaaagttacccgaaagttaccgggaacccctaaaacgaaacccggtaaacctaaaacccgaacccttaaccccgaaaccgggtaacggaacccctaaaccgtaccgggtaaccccttaaacgaaacggttaccggggaaaaccgttaggggaaaacccgggtaaaccgtaaggtaaacgggtaacttaccggtacggtaaaccggaacccgtaaccggggtacctttttaaagtattttaacggtttgggtaccgtaacggaaggtaaacgtaaaccttaaaacgttacccttaccctttaaaactaacttacggttaaacccgtaacggtaaacgttaggggtaaacgtttcgtttaaccgtttttaacttttacccgg

SEQ ID NO: 392359 - DNA, 663 bp, Homo sapiens
  misc_feature: GZ8MTXP02HE6B6.39.81.H04.1.454.CMB.2.raw
  modified_base (260)..(260): a, c, t, g, unknown or other
  modified_base (281)..(281): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacacctttaccaactntggtatcaggttggtgcgacncggccccgtggacaagggcttggagtggagtgggatggatcgagcgtcttaacgaagtggtacaaacgaactaaaactataccgacaacgacgaaacccctcgaacgggacaggacgtaccaaaccgtagaccgaaccacgacgaaaccaacactaccgaacgacgacccgacggaccctacacgtacggacccgtaggacgggtacgaccgtaggaagtacgtaccgtacgaaccggaaccgaacccgggtcgttacggttaacgtttaccgtggtacgtacggaaggtacggtaacggtaacgggggttaaatttagtttacgtacgttaccgttaaccgttcgttacgtacgtacggtcgggaccgtaacgggtacccg

SEQ ID NO: 392360 - DNA, 723 bp, Homo sapiens
  misc_feature: GZ8MTXP02GNNT0.39.81.H04.1.454.CMB.2.raw
  modified_base (215)..(215): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctnagtgaggtctctgcagtcttctgttactacctttacaactatggtatcgtaggttggtcgcgacgacggtccccgtagggacgaaggtcttaggagtggagttgggatggactcgaggcgtacttaacgaagttcggtaccaaacgaaacctaaacgtacgtacgaaccccaaacgaaccgtaacccgtacggacggggtacaagggtcgtaccaaccgtaagtaccgaacccaacgaaacgtaaccaaaccaccgtaacccgaaacgaacgccgaacccgtacctaaacgcgtacggaccgtaggacggtacgacccgtaagacgtaacgtccgtaacgggacccgaaccggaccggttaccggttgttaacgttacgtggtacgacgggtaaggaaacgggtaggttaaacggtaaacttttagttaccgacgtttaccggttacccgtttaagtttaccgaaaccggttcggggtaccgggaccgtaaccgggttaaccgtccgg

SEQ ID NO: 392361 - DNA, 647 bp, Homo sapiens
  misc_feature: GZ8MTXP02H3UH9.39.81.H04.1.454.CMB.2.raw
  modified_base (343)..(343): a, c, t, g, unknown or other
  modified_base (352)..(352): a, c, t, g, unknown or other
  modified_base (525)..(525): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctcagtgaaggtctcctgcaaggcttctggttactacctttacaactatggtatcagttggggtgcgacacggcccctaggacaagggcttggagtggatgggatggatcgagcgcttacaagtggtacanaacaaactntgaccacaacgaaccctccgaggggcaagacgtaccaaccatacgaacccacgacgaacaaccacacccaacggacgacccgacccggtaccctaacgacgtacggaccctggaacggacgcctagacgtatcgacggaccgacgaccgggtaccgttagtactttaaccggngtacggacggtaacggtaacggtacggttaaacgggtaaatttacgtttacgaccgttccggttaacccttcgttacggtacgtaccggggtaccgggacccggtaaccgggtacccgtcgg

SEQ ID NO: 392362 - DNA, 693 bp, Homo sapiens
  misc_feature: GZ8MTXP02F75KD.39.81.H04.1.454.CMB.2.raw
  modified_base (290)..(290): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgaaggtctccgtgacgaaggtcttcgtaggttacctacccgtttaaccaacttagtggtatcgtaggttggngcgacgacggcccctaggaacgaagggtcttaggagtggagtgggagtggatcgagcgtacttaacgaagttggaaccaacaaacgtaaaactatacgacccaaaccgtaaccgtaaacccacggaacggggaccaaggacgtaccaaccgtaactaccgaaacccaacgaaacgtaaccaacctacacccgaacgacgacccgaacgtaccctagacgtaccggaccagggacggtaccgccgtagaacgtactacgacggaccgaaccgccggtcttagtaacttcgagtacggagtaaggacggtaggtaaacgggttaaatttagttacgtaacgttccggttaccttgtttaacggaccgtttacgggaccgggtaccgtaacgggtacccgttacgg

SEQ ID NO: 392363 - DNA, 670 bp, Homo sapiens
  misc_feature: GZ8MTXP02I3UYA.39.81.H04.1.454.CMB.2.raw
  modified_base (239)..(239): a, c, t, g, unknown or other
  modified_base (271)..(271): a, c, t, g, unknown or other
  modified_base (351)..(351): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttntggttacacttacactatgtatcaggttggtncgacacggcccctggacaaggcttggagtggagtgggatggatcgagcgctttaacgaagtggtcaacaacaaaacttancggaccaacaacgaaccctcgaagggcaggactacaccatacgaaccaagacgaacacactaccaacgacgaccgaaccggtccttaaacgacgttacgggaaacccgttagggaacgggtaacggacccgttaaggaaggtacttacggacgaacccgacgacccggggtcgttacggtaacttttaacgggtacgtacggacggtaacggtaaacgggtacgggttaaacgggttaaattttacggtttacgtaccggtttaccgttaaccgttacgttacgtacgtacggtaccgggtaaccggtaaccggtaccg

SEQ ID NO: 392364 - DNA, 645 bp, Homo sapiens
  misc_feature: GZ8MTXP02JP8JT.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttgggtgcgacacggcccctaggacaagggcttggagtggagtgggatcggatcgagcgtacttaacgaagttggtacaacgaaactaaaactatacgacccaacgaacgaacccgtccgaaggggacaaggtacgtaccaaccataccgaaccaacaacgaaccaactacacccgaacgacgaccgacccggacctaacgagtacgaccgtaggacgacgcgtaggagtactcgtacgacgaaccgacgggtaccgtagttaacgttaccgtggtacgacggaagtacggtaggtaacgggttaaagttgtttacgtacgttacgtaccttgttacgtaacgtcggtacgggaccggtaaccggtaccgttaccgg

SEQ ID NO: 392365 - DNA, 837 bp, Homo sapiens
  misc_feature: GZ8MTXP02GNFAQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctggtacagtctggagctgagatgacgaagccgtgggcctcagtgaaggtctccgtgacgtaaggtcttcgttacggttaacctaaccctttaaccaaacttagttaggttatcgtaggttgggtcgacgaccgacggtccccgtagggaaccgtaagggtcttaggaggtaggtagtgggagtgggaatcgaaggtcgtacgtttaacgaagttcggtaacaaacctaaactaaaacgtagtacgacccctaaacgaaaccgtaaacccgtccggaagggaccaacggtacgtacccaaaccctaagtaccgaaacccaacgaaacgaaccctaaaccaaccacccgaaacggaaccgacccgttaaacccggtaccctaacgaacggtaccgggaaccctagggaacggtaacgaccgtaaggaagtacgttaccgtaacgggaaccgaaaccgccgggttaacccggttagttaaaccgtttacggtacggtaacggaacggtaaaggtaacgggttaaacgggttaaacgggttaaaagttttacggtttaacggtaaacccggtttacccggtttaacccttaacggtttaaccgggtaaccggttaaccggggtaccggggtaaacccggtaaacccggggttaacccgttacgg

SEQ ID NO: 392366 - DNA, 714 bp, Homo sapiens
  misc_feature: GZ8MTXP02JSJV0.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtgggcctgagtgaggtctccgtgacaaggtcttcgtaggttaacctaccctttaaccaacttagtggtatcgtaggttgggtgcgacgacggtccccgtaggaccgaagggtcttaggaggtaggaagtggggacgtagggactacgaggtaccgtacgttaaacgaacgttcggtacaaacgtaaacctaaaacgtagtacgaccccaaacgaacgtaaacccgtaccggagggacgaagaccgtaaccaaacctacgtacgaaccctacgaaacgacccaacgacctaaccgacgacgactaccgactacgagtacggactaggagactacgagagtactcgacgaaaccgcgacggtaccgtagtactacgtgtacggacgtaagtagggacgttaaaacgggtaatttagtttaccggtaacgttccggtttacctttaaacggttccgtaaacggttaccggggacggggttaaccccggtaacgggtaacccgtttccgg

SEQ ID NO: 392367 - DNA, 633 bp, Homo sapiens
  misc_feature: GZ8MTXP02H2KEE.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctcagtgaagtctctgcagtcttctgtactaccttacactatgtatcgtagttggtgcgacgacggcccgtggaacgtaaggtcttggaggtaggagtgggataggatacgaggcgtacttaacgagtggtacaactaaacaaactgtcgacccaacgaccgaaccgtaccgaggaccagccgtacaaccacgtaccgaccaacgacaaaccacactacccgagacgccgaaccgtacctaacgcgtacggacgtacgagggacgtccgagtacgtacgtacgtacggaccgaccgtcgggtaaccgtttaggtacttacgttacggagtacgaggtaagtaggtaaacggtaaatttacgttacgaccgtttcgtacctttaagtcgtaaacgtcgggtaccggaccgtacggtaccctcgg

SEQ ID NO: 392368 - DNA, 657 bp, Homo sapiens
  misc_feature: GZ8MTXP02IFLI2.39.81.H04.1.454.CMB.2.raw
  modified_base (524)..(524): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcgtaggttggggtgcgacgacggcccctgggacaagggcttggaggtggagtgggatggatcgagcgtacttacaagtggtacacaaacaaactatgacccaacacgaacctccgagggacaggcgtcaaccagtacgaaccacgagtaccaacgactacccgaacgacgactaaccgggccctaagagtcggacccgtagaggacgtccgtagagtatccgaggaaccgacgacggtaccgttgtaagtttaccggnggtacggaacggtaaggacggtaaacgggtaacggggttaaaatttcgtttacggaccgtttaccggttaccctttaaggttacggtaaccggttacgggtaccggggtacccgtaaccggggtacccgtcgg

SEQ ID NO: 392369 - DNA, 632 bp, Homo sapiens
  misc_feature: GZ8MTXP02GO147.39.81.H04.1.454.CMB.2.raw
  modified_base (260)..(260): a, c, t, g, unknown or other
  modified_base (265)..(265): a, c, t, g, unknown or other
  modified_base (384)..(384): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctctgcagcttctgtacacttacatatgtatgagtggncgacncggccctggacaggtctgagtggatgggatggatcgagcgtacttaacaagtcggtacaacgaactaaactatcgacccaacacgaacctccgaggacagactaccaacatacgaccanacgtacacactacccgaagacgacccgaacgtaccacgtacgtcggaaccgtaggacggaacgtccgtaggaacgtacgtaccgtaagggaacccgtaccggtaacgggttccgttaacggttaacgttcggtaggtacgacggtaaggacgtaagggttaacgggttaaaatttcgtttacgacgtttacgtacttaacgtttacgacggttacggtccgggtaaccgtacgggtaaccgtttccgg

SEQ ID NO: 392370 - DNA, 681 bp, Homo sapiens
  misc_feature: GZ8MTXP02HVRZL.39.81.H04.1.454.CMB.2.raw
  modified_base (288)..(288): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctctgcaaggcttctggttactacctttacaactagtgtatcgagttgggtgcgacacggccccgnggacgaagggcttggagtggatggggatggatcgagcgtacttaacagttcggtacaacaaacgaaactatacgaccaacgaacgtaccctaccggagggtaccacggacgtccaaacctagtaccgaaccacgaacaaccgtaacacaacccgacgacgcccaaccgtacctaacacgtacggaccgtagacggaacgcccgttagacgtagtacgtacggaccacggaccggtacccgttagtacgttagtcgtagtaccgacggtaaaggtacggttaaacgggtaaacgtttaagtttccggtaacggtttaccggtttaacccgttcgttttacggaaccgtttacgggtaccggggtacccggtaaacgggtttacccgtacccggg

SEQ ID NO: 392371 - DNA, 585 bp, Homo sapiens
  misc_feature: GZ8MTXP02F95B1.39.81.H04.1.454.CMB.2.raw
  modified_base (236)..(236): a, c, t, g, unknown or other
  modified_base (290)..(290): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagccgcctcatcctcctgcaggtctagtacaaagcctgtanacattgataggaaacactacttgaattggttcagcagacggccaggccaatccncaaaggcaccttaatttacgtaaggtttcaaaccgggcttcgtgggtcccagtacagtattcgagcggactaggtgggtcaggcaactgaacttcacgactaagaaactcaggacgtagggtgacgcgtaggaaggtgttagggtttagggtttatacgtggtactagtacgacgtaaacgaactacgtagtcggtaccgtaccggttacgtacgtttcggaccggaacgggtaccaggtacgtacggaagtactacgaaaacgaagtcgtacggctacggacctacgtattccg

SEQ ID NO: 392372 - DNA, 695 bp, Homo sapiens
  misc_feature: GZ8MTXP02FWLP2.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctcctgcagtcttcgtgttactacctttacaactatggtatcgtaggttgggtgcgacgacggccccgtaggaacgaagggtcttggaggtggagtggggatggatcgaggcgtacttaacgaagtcggtacaaacgaactaaatacgtcgaccctaacgaaccgtaaccgtaccggaaggaccaaggtaccgtaccaaacctaacgtaccgaaacccgaacgaacgaacccaactaaccgacccgaacggaacgccctaaccgggaccctacgtagtaccggaccgtaggacggtacgcctagacgtacttacgacgaacgacccgtagggtaccgttagttaacttcgagggtacgacggtaacggaggttaaacggtacgggttaaaattcgtttacgaccgttccggttaaccttcgtttacgaacgttacgggtccggggtaaccgtaaccgggtaccgtttccgg

SEQ ID NO: 392373 - DNA, 635 bp, Homo sapiens
  misc_feature: GZ8MTXP02IGZ7U.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttgggtgcgacacggcccctggacaagggcttggagtggatgggatggatcgagcgacttaacaagtggtacaacaaacaaaactatgacccaacgaacgaaacccgtccgaaggggccaaggacgtaccaaaccaatacgaaaccacaaacgaacaacctacgacccaacgacgaccgtaaccggcctaaaccgagtacggaaccctggaacgacgtccgtaggacgtatacgacggaccgaacgaccgggaccgttagtaacttacgtgtacggacgtaaggaacgaggtacggggtaaaattgtttacgacgttaccgtaccgttcgttaggactacggtcgggaccgaacgggtaccctacgg

SEQ ID NO: 392374 - DNA, 689 bp, Homo sapiens
  misc_feature: GZ8MTXP02HSI28.39.81.H04.1.454.CMB.2.raw
  modified_base (451)..(451): a, c, t, g, unknown or other
  modified_base (490)..(490): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccaatcccaggttcagctggtacagtctggagctgagatgacgaagccgtggggcctgagtgaaggtcctcgtgacaaggcttctggtacctaacctttacaactgtagtatcaggttgggtgcgacgacggcccctggaacgaaggcttaggagtggagtcgggagttacggactcgaacgtcgtacgttaactaagtcggtaccaaacaaacctaaatacgtacgacccaacgtaaccgtaacctcggaaggtccaagtaccgaccaactagaccaccgacacgacactacnccgaaacgcactaccgcacgacgtcgacaggacggaccncgtagacgtacgtacgtacggaccgtaccggtaccggtacgttacgttaacgttcgtaggtacggaacgtacgggtaaggttaaacggttaaacggtttaaagtttacggttaccgtacccgtttaccggttaccttaacggttccggtaaaccggttccggggtaaccggtaacccggtaaccggttacccggtacgg

SEQ ID NO: 392375 - DNA, 750 bp, Homo sapiens
  misc_feature: GZ8MTXP02HSXME.39.81.H04.1.454.CMB.2.raw
  modified_base (265)..(265): a, c, t, g, unknown or other
  modified_base (606)..(606): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagcctggtacagtctggagctgagatgacgaagccgtggggcctcgagtgaaggtcctcctgcaaggtcttcgtggttaccacctttacaacttntggtatcaggttggtgcgacgcgcccctggacaaggctggagtggagtggatggtactgagcgtcgttacaagttcggtacaacgaacgtaaacttagtacgacccgaacaaccgtaaccccttcggaaacggggaccaacgggtaccggttaccaaacccgtacgttaccgaaaccccgaaacgacggaaaccccttaaacgaaccttcccccggaaacggacgaacccgaccggggtaccccctaaagtaccgttacgggacccttaggacggtaacgtccggttagacgtaacgtcgtacgggaccgtaccggaaccggtcgtagttacgttaaccgnggttacgacggaaccggtaaggtaacggttaacgggtaaaacgttttaccgttacggtaccgtttaccgggtaacccgttgtttaaccgaaccggtttaacgccgggggtaacccgtaaccggggttacccgtttaacccgggg

SEQ ID NO: 392376 - DNA, 728 bp, Homo sapiens
  misc_feature: GZ8MTXP02I3ULQ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtctcctgacaggtcttctggttactacctttacaacttagtggtatcgtaggttgggtgcgacgaccggcccgtggacgaagggtctaggaggtggagtggagtggatcgagtcgtacttaacgagtcggtacaaccgaaactaaactagtacgacccaacgaaccgtaaaccccgtaccggaacggggaccaaggtaccgtacccaaaccgtacgaacccgaacccaacggaaaccgaaccctaaacctaaccgttacccccgaaacggtaccggtaacccgaacccggtacctaacgcggtaaccggaaccgtagacggaacgtccgtagacggtacttccgacggaacccgaccgtacggtaccgtttacgttaagttaccgtggtacgaacgttacggaaggtacggttaacggtaaattttacggttacgacgtttaccggttaccctttaagttcgtaacgttacggggccgggtacccgtacgggtacccgtttaccgg

SEQ ID NO: 392377 - DNA, 646 bp, Homo sapiens
  misc_feature: GZ8MTXP02FHL57.39.81.H04.1.454.CMB.2.raw
  modified_base (319)..(319): a, c, t, g, unknown or other
  modified_base (351)..(351): a, c, t, g, unknown or other
  modified_base (373)..(373): a, c, t, g, unknown or other
  modified_base (388)..(388): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatcccttttcttggtggcagcaacaacaggtgcccactcccaggttcagctggtacagtctggagctgagatgacgaagcctggggcctcagtgaaggtctcctgcaaggcttcgtggttaccacctttaccaactatggtatcgaggttgggtgcgacacggcccctgggacaagggcttggagtggatgggntggatcagcgcttaacatcggtcacacaactntgcacagacctcgagggcaggntcaccatcgaccaanacgaacacaactcccaacgagccacggtaccctaacgacgtcggaccgtaggacgggacgcccgtagacggtaacttccgtacggaaccggaccgtaccggggaccggttaacgggtttaacttaaaccgtgggttacggccggaaacggaaggtacgttaaaccgggggtaaaatttacgtttttacgaaacgttcggtaacccccttgttacgacgttaacggttcggggacccgtaaacggggtaccccttcggg

SEQ ID NO: 392378 - DNA, 593 bp, Homo sapiens
  misc_feature: GZ8MTXP02HRFG2.39.81.H04.1.454.CMB.2.raw
  modified_base (215)..(215): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgaaggtctcctgcaaggcttcgtgttactaccttacaactatgtatcgaggttggtgcgacacggccccgtaggacgaaggtcttgagtggagtgggatggatcgagcgtactagtaagtgtacaacaacaaactatcgacaacgacgaccgtcgaggacagacgtacacatacgaaccacagacactacacccgaggacgtcccgacgacctaacgagtacgggacctaggacggacgcgtacggtatactacgacggaccgacggtacggtcgtaagtattcgtgtcgacgaagtaggacgtaacgggttaaattacgttacgtacgtcggtttaacccttgtacgtacgtacggtcggaccgtacggtaccg

SEQ ID NO: 392379 - DNA, 619 bp, Homo sapiens
  misc_feature: GZ8MTXP02JDS36.39.81.H04.1.454.CMB.2.raw
tcagtcgcactagtcacgaccggtgctcgatttagtagtgtagattcgcgggtactgatcaggactcctcagttcaccttctcacaatgaggctccctgctcagctcctggggctgctaatgctctgggtcccaggatccagtggggatgttgtgatgactcagtctccagtcctccctgcccgtcacccttggacagccggcctccatcctcctgcaggtctagtcaaagccctgtatacattgataggaaacaccttactagtaattggttacagcaggacggccaggacctaatctaccgaaggcctaccttaaatttagtaacggtttaccgtaaaccgggacttcggtacggggtaccccaagactagtacttcgaggcggcgtaggtcgggcacggcacgtagtaacttcgaactataagaaatcgagacgaggggtggagcgtaggtaggtagttggtttagggttactacgtgactagtgacgaaagtaacacgtacgtcgtaccttaccgtagtacgtttcgggaccggtaacggggaccaaggtacgtagggtaacgaactaccgaaaacgtaacgtcggttacggacgtacgccaaccgtacgtttcg

SEQ ID NO: 392380 - DNA, 705 bp, Homo sapiens
  misc_feature: GZ8MTXP02IRF78.39.81.H04.1.454.CMB.2.raw
  modified_base (309)..(309): a, c, t, g, unknown or other
  modified_base (420)..(420): a, c, t, g, unknown or other
  modified_base (434)..(434): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaaggtcttcgtaggttactacctttacaactagtggtatcgtaggttggtgcgacgacggcccgtggacgaggcttagngtggagtgggatggactcgagcgtacttaagagtgaccaacgaaactaaactagtcgacccaacgaacgaaccctcgagggaccagggactccgaacgactacgacccaanacgaccaagtaccnccgaaacgagtacccaccggtacctaaacgacgttacgggaaccctaggggaacgaccgtccgtagaaacggtactacgtacgggaacgacccggtaacgggcccgtttaaggtaaacgttacgttacgggagaacccgggttaaaggacggtaaacggttaaacggggtaaaacttttaggtttaccgaaccgttttacggaccccgtttaagttaaggacccgtttaaacggggcgggtaaaccccggttaacgggaacccgtttcggg

SEQ ID NO: 392381 - DNA, 738 bp, Homo sapiens
  misc_feature: GZ8MTXP02IJJ0F.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcagtgaaggtctcctgacaaggtcttcgtacggttactaaccctttacaacgtattaggtactcgtaggttgggtgcgtacgacggcccctaggaacgtaagggtccttggtaggtaggagtggggtagtggagtcgaacggcggttacttaaacgtaaaacgttcggttaacaaaccgtaaaacctaaaacgtacgtaacggacccaaaaccgaaaaccgtaacccccgtacggaacgggactaacggaccgttaccaaacctacgtaaccgaaaccccgaagaaccgaacaaaccactacccgagaccgaccgaacccggacctacgagtacggaccgtaggaacgacgacccgtagaacgtacgtacgaccgaacgaccgaaccggaccgttagtaaacgtttccgtagtcggaacgtaacggagtaggttaaacggtaaagtttcgtttacgaccgttacggttaccttaacgttacgtaacgttcgggtaccggacgtaaccggttacccgtaccgg

SEQ ID NO: 392382 - DNA, 657 bp, Homo sapiens
  misc_feature: GZ8MTXP02JB99F.39.81.H04.1.454.CMB.2.raw
  modified_base (342)..(342): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacctaccctttaccaactatggtatcgtaggttgggtgcgacgacggcccctgggacaagggcttggagtggagtgggagtggatcgagcgtcttaanagtcggtacaacaacaaactatcgaccacaacgaaccctcgaggacagcgtcaaccagtacgaccaagacgacacacaccacgacgccgtacgacctacgacgtcggaactcggagacgaccgtagacgtacgtacgacggaaccgtaaccggccggtaccggttagttaacgtttaccgtggtacggtaccgggaagtaacgggtaaggttaaacgggggttaaaattacggtttcgtaaaccgttcggttaccctttcgtttacggtaccgttacgggtacggggacccggttaaccgggtacccgttaccgg

SEQ ID NO: 392383 - DNA, 675 bp, Homo sapiens
  misc_feature: GZ8MTXP02FQYN3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctggagatgacgaagccgtggggcctcgagtgaaggtctcctgcgaaggtcttcgtggttacctacctttacaacttgtggtatcgtaggttgggtgcgacgacggtccccgtaggaccgaagggtcttaggaggtggagtgggatggatcgagcgtacttacgaagtcgtacaaacgaacaaactacgtacgaccctaaccgaacgtaaccctcgaacggggtaccaacggtaccggtacccaaacctaacgaaccgaaccccaaacaacgaacccttaacgagtaccccgaagaccgacgaacccggtaccaccgagtacggacctaggaacgacgtaccgtagacgtacgtcgttacggaaaccgacccgacggtaccgtagttaacgtcgtaggtcgacgagaggaggtacgggtaaattcgtttacgtactcgttaccgtcgttcgaccgtacggtgggaaccgtacggtaccgttaccgg

SEQ ID NO: 392384 - DNA, 651 bp, Homo sapiens
  misc_feature: GZ8MTXP02HJBJ6.39.81.H04.1.454.CMB.2.raw
  modified_base (151)..(151): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaanaccggtgcccactcccaggttcagctggtacagtctggagctgagatgacgaagccgtggggcctcagtgaaggtctcctgcaaggcttctggttacacctttaccaactatggtatcagttgggtgcgacgacggcccctggacgaaggtcttgagtggagtgggatggatcgagcgtacttacgatggtacaacgaactaaactatagacccacaacgaacctcgaggcaagcgtaccaaccagtcgaacccaacgacgaacaactacacccaacgacgaccgaccggacccttaacgagtacggacctaggacggaacgtccgtagacgtactaccgtaggaaccgacccgacgggtacccgttaggtaacttacgtcggtacgacggtaagacggtaacggttacgggggtaaaatttcggtttacgaaccgttcggttaacccttcgttttacgaccgtttacggcgggtaccgtaaccgggtaaccgttccggg

SEQ ID NO: 392385 - DNA, 715 bp, Homo sapiens
  misc_feature: GZ8MTXP02HA73N.39.81.H04.1.454.CMB.2.raw
  modified_base (213)..(213): a, c, t, g, unknown or other
  modified_base (270)..(270): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgaacgagccgtgggctnagtgagtctctgcgaagtcttcgtgttactaccttacatagtggtatcgtagttggngcgacgacggcccgtaggacgaggtctggagtggagtggatggactcgagtcgtacttaacgagttcggtaccaaactaaacgtaaaactgtacgaaccgtaaaccgaaccgtaacccgtacggacgggacaaggtaccgtaccaacgtacgaaccgaacccaacaaagtacccaaacacctaccgaacgacgtacccgaacgtacctaagacgtacggactagggaacgcgacgtagacgttacgcgtaacggaaaccgacggtaccggtaccgtttaagtaacgtttacggtacggtaggaacggtaaaagtacgggtaacggttaaaacggttaaagttttacggttttacggaccgtttaaccggtttaccccgtttaaggttacccgaaaccggtttacggggacccggggtaacttaaccccggggttacgttacccgg

SEQ ID NO: 392386 - DNA, 678 bp, Homo sapiens
  misc_feature: GZ8MTXP02I9JA6.39.81.H04.1.454.CMB.2.raw
  modified_base (272)..(272): a, c, t, g, unknown or other
  modified_base (323)..(323): a, c, t, g, unknown or other
  modified_base (466)..(466): a, c, t, g, unknown or other
tcagtcgcactagtcacgaccggtgctcgatttagtagtgtagattcgcggggacccaaaaaccacacccctccttgggagaatcccctagatcacagctcctaaccatggactggacctggagcatccttttcttggtggcagcaacaacaggtgcccactcccaggttcagctggtacagtctggagctgagatgacgaagccgtgggcctcgagtgaaggtctctgcgagtcttctgttactaccttacaactatgtatcgtagttggncgacgcgcccctggacaggctgagtggagtggatggatcgagcgacgttanaagtcgtacaacaacaaactatacgacaaccgaacgtaaccgtacgaacgggacagaacgtaccaacgtactaccgaaccaaccgaacgaaaccactaaaccgtaccccgaaacggtacgacccgtacccgggacccttaaancggtaacggaccgaggaacggtacaccgtagaacgttacgtccgaagaccgtaacgaccggttccgtagttaagtctcggagtacgaaagacggtaggttaaacgggttaaattacgttacgtaacgtttaccgggttaccctttgtaacggtaaacccgtacgggttacggggaacccgtaacccgggttaacccgttcggttaacccccg

SEQ ID NO: 392387 - DNA, 675 bp, Homo sapiens
  misc_feature: GZ8MTXP02HGPAE.39.81.H04.1.454.CMB.2.raw
  modified_base (224)..(224): a, c, t, g, unknown or other
  modified_base (486)..(486): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctgagtgagtctcngcagtcttcgtgtactaccttacaactgtgtatcgtaggttggtgcgacgacggcccgtaggaacgaaggtcttggaggtaggaggtgggagtaggatacgagcgtacttagtaagtcgacaacaaactaaatagtacacccaaccgaaccgtaacccgaccggaggaccaacgtacgtaccaacacgacgacccaacgaactacacacacccgaagccgacgaaccggtctaacgcgtacggaacgaggacgcgcgtaagngtaacgtcgacggacgaccggacggttacgtagtacttacggaggtaggacgtaaaggtcggtaaacggttaaacggggttaaattacggtttacgtacccggtttaccggtttaaacccttcggtttaacgtaccggtttaaccgggggacggttaacccccggtaacgggttaaccccggtttccgg

SEQ ID NO: 392388 - DNA, 716 bp, Homo sapiens
  misc_feature: GZ8MTXP02I4HEB.39.81.H04.1.454.CMB.2.raw
  modified_base (300)..(300): a, c, t, g, unknown or other
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccaggtggggatgttgtgatgactcagtctccagtctccctgcccgtcacccgttggacacggcccggcctccatcctcctgctaggtctagtcaaagcctacgtatacattgataggaaacaccttacttagaatttggttcagcagaggccaggccaatccncgaaggcaccttaatttagtaggttacctaaaccgggtctcgtcggggtaccagacgtagtacttacgacggcgtacagggttcggggtacacggggtccaacttacggtaaactttccgaaactaaccgttaaagaaaaacttacgaaggtacggaagggggttagggaacgggtacgtagggaagggtaaggtttggggtttagggggtttaacttacggtacggtacgtaaggttacggaaacgaacgggtaaacaccgtaacgtccggtacccgttaccggttaccttacggtttcgggaacccggttaacgggggacccgtaaggtccggtaaggaacggtaacgtaaaccgtaaaaccggtaacgttgggtacggtacgtacggtacctaaaccggtctttaccgtttcg

SEQ ID NO: 392389 - DNA, 612 bp, Homo sapiens
  misc_feature: GZ8MTXP02HYVAS.39.81.H04.1.454.CMB.2.raw
  modified_base (270)..(270): a, c, t, g, unknown or other
  modified_base (306)..(306): a, c, t, g, unknown or other
  modified_base (526)..(526): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctctgcaaggcttctgttacacctttacaactatggtatcagttggtncgacaggccctgacaaggctgagtgatggatggatnagctcttacatggtacacacgtaaactatcgaccaacgaacgtaacccctccgaagggaccaaggacgtaccaaaccgtagacgaaacccacgacaaccgaaccacgacccgaacgacgtcccgaaacccggacccttaaccgaacgtacggacccgttaggaacggaacgtccgtagacgtacttcgagaccgacgacggtccgtagtacttacgtagngtacgaagtacgtaggtacggtaaaatgtttacgacgtttacgtaccttcgttagaccgttcggacggaccgtacggtacccgtcg

SEQ ID NO: 392390 - DNA, 673 bp, Homo sapiens
  misc_feature: GZ8MTXP02IW2VH.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtcgcccactcccaggttcagctggtacagtcgtggagctggagatgacgaagccgtggggcctcagtgaacggtcctctgcgaagtcttcgtggttacctacctttacaactagtggtatcgtaggttggtgcgtacgacggccccgtaggacgaaggtctgaggtggaggtggatcggatcgacgcgtacttaacaagttcgtaacacgaaacaactagcgaacccaaccgaacgtaccctacggacggacaacggtacgtccaaactacgaccgaaccacgaaactaccaacacaacccgacgacgtaccgaaccgtacctacgataccggacgtaggacggacgtaccgagaacggttacgtacgacggaaccgtaacccggtaccggtccggttaagttacgttcgtagggccaggtagaacgtacggtaacgggttaaaattttggttaccgaacgtttcgtacccgtttgttacgaccgtttaccggagggtacccgacggtaccgtaccgg

SEQ ID NO: 392391 - DNA, 623 bp, Homo sapiens
  misc_feature: GZ8MTXP02IZC0F.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgaggttgggtgcgacacggcccctggacaagggcttggagtggagtgggatggatcgagcgtacttacaattggaccaacaacaaactatcgaccaacgacgaaccctccgaggaccagacgtccaaccgaatcgaaccacaagaccacacacccgaacgacgcctaaccggacctacagtcggaacctgacggacgcctgactatccgaggaacccgacgacggtcgtagtacgttactggtgacgtaagacggtacgtacggggttaaaattcgttttacgacgtttacgttaaccccgttgtttaccgaacgttaaccggtcggggacccgtaacggggtaacccccttaggg

SEQ ID NO: 392392 - DNA, 725 bp, Homo sapiens
  misc_feature: GZ8MTXP02HE2M4.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcacccttggacagcccggcctccatctctgcaggtctagacaaacgccttacgtatactattgatacggaaacaccttattgtaatttgtttcagcagaggccaggccaatccacgaaggctaccttaaattttagtaaacggtttaccgtaaccggtcttaccggtcggggtacccagtaaccgagtactttacgaggtccggacgtaaggggttgggtaccgagggtactaacgttaggtaaacctttcaaaccgaacgttaaacgaaaaagttcccgaaagggaccggttaagggggtggggaacggtcgtaggggtaaggggtagtttagggtttagggggttttaaacttcggtagacgtagtacggaacgaaaggaacgacgtacgttacggacccttaccggttaacgttaccggtttacggaccggtaaacgggggtaaccaacggtaccggtagggtaaacgtaaaccgttaaccgaaaacggtaaaccgttgggtaacggtaccggacggtaccgtaacctaactttccgg

SEQ ID NO: 392393 - DNA, 681 bp, Homo sapiens
  misc_feature: GZ8MTXP02GZW5N.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctcgcccgtcacccttggacacgccgcctcatctcctgcaggtctagtacaaacgtcctgtatacattgatagaaactacctatagtattggttcagcagcgccagaccaatctacgaaggcctacttaatttacgtaaggtttaccgtaaccggctcggtcggggtacccaaggtaccagtactcgaacggtcggtacgtagggtcgggtccgaacgggtactaacgttagtaaactttacgaacctaaacgtaaagtaaaactccgaaggacgggtaagggggtagggaggtaccgtagggtaaaggggttaggtttaggggtttaggggttttaaacttacgttagacctagtacgaacgaaaaggaaccacgtacgtaccggtaccgttaccgttaacgtcggtttaccggaccggaaacggggacctaaacggtcgtagggaaactaacgtaacgaaaaccgtaagtcggtacggtactacgtacctaacgtcttaccg

SEQ ID NO: 392394 - DNA, 670 bp, Homo sapiens
  misc_feature: GZ8MTXP02HCM1M.39.81.H04.1.454.CMB.2.raw
  modified_base (228)..(228): a, c, t, g, unknown or other
  modified_base (267)..(267): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgagtctcctgnagcttctgttacaccttacactatgtatcgtagttgggnacgacgacggccccgtgggaacgaagggtcttaggaggtaggagtggggagtggactacgacgtcgtacttacgaagttcggacaaacaaactaaacttgacgacccaacgtaaccgaacctcggaaggaccagtacgtccaacgtagaccgaacccagaacgaaccacaccgacccgagacgaccgacccgtactacgagtccgaacgcggaacgggactaccgaggaaactcgtacgaggaaacccgacgtacggtccgttaagtacttaccgggaggtacgacggtaaggtacggttaacggtaaacggttaagtttacgttacgtaccgtttaccgttacgttaacggtaacggtaaccggtacggggtaccggtaaccggtaaccgggtaccgtaccg

SEQ ID NO: 392395 - DNA, 656 bp, Homo sapiens
  misc_feature: GZ8MTXP02FI6P8.39.81.H04.1.454.CMB.2.raw
  modified_base (239)..(239): a, c, t, g, unknown or other
  modified_base (354)..(354): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttntgttacacctttacaactatggtatcaggttggtgcgacacggcccctggacaagggtcttgagtggatgggatggatcgagcgtcttaacagtggtaccaacaacaaaaccttntacgaccccaaccgacgaaacccgtcgaaggggaccagtacgtaccaacccgtataccgaaacccacgaacggaacccaacaactacccgaaacgacgacccgacgtacctacgagtacggacctaggagggacgccgtagagactcgtacggacgaaccgacggtaccgtagtacttacgtgtgacgtaggaggtaagtacgggggtaaaattagtttaccgtacgttacggttaccccttaacgtttacggtaacgttaccgggttaccggggaccggtaaccggggtacccgtaccggg

SEQ ID NO: 392396 - DNA, 674 bp, Homo sapiens
  misc_feature: GZ8MTXP02F7T5B.39.81.H04.1.454.CMB.2.raw
  modified_base (275)..(275): a, c, t, g, unknown or other
  modified_base (592)..(592): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttctgttactaccttacaactatggtatcgaggttgggngcgacgacggccctggacgaggcttaggagtggagtggagtggatcgagcgtacttaacgaagtcggtaccaacgtaaactaaactacgtacgaacccaaccgaaccgtaaacccgtccggaacggggaccaagggtacgtccaaaccgtagtacccgaacccaaacgacgaaaccctaaccaaccgtacccgaaccggaacgtcccgaaacccgggtaccctaagtacgttacggggaaccctagggacggtaacgtccgtaaggacgtacgttaccgaggaaccgtaccgaccgggtcttaggtacttcggtagngacgaggaagtaggtaagggtaaattgttacgtacgtcgttcttaacgttcgaacgttacggcggaccgacggtacctacgg

SEQ ID NO: 392397 - DNA, 671 bp, Homo sapiens
  misc_feature: GZ8MTXP02I6MGH.39.81.H04.1.454.CMB.2.raw
  modified_base (328)..(328): a, c, t, g, unknown or other
  modified_base (348)..(348): a, c, t, g, unknown or other
  modified_base (431)..(431): a, c, t, g, unknown or other
tcagtcgcactagtcacgaccggtgctcgatttagtagtgtagattcgcgggggacccaaaaacccacacccctccttgggagaatcccctagatcacagctcctcaccatggactggacctggagcatcccttttcttggtggcagcaacaacaggtcgcccactcccaggttcagctggtacagtctggagctgagatgacgaagccgtggggcctcagtgaggtctctgcaggcttctgttacaccttacatatggtatcgagttggtgcgacaggccctggacaaggggcttggaggtggagtgggatggatcgagcgtattanagtgtaccacgactaaactntcgaccaccacgaccctacgaggcagcgtcaaccagtacaacctacgaacgacaacactaccgaacgacgacgacccggtacncgaagtacgggacctaggaacggacgtacctaggaacgtaccgttaccgacgggaacccgaaccggaccgggtccgttacgttaacgttcgtacgtacggtacggtaaggtacggtaacggtaaccgggggtttaaaatttacggtttttacggaaccggtttcggtttaacccgttgttttaaccggaacggttacccggggttagggggaacccgtaaccgggggtaaccctttcggg

SEQ ID NO: 392398 - DNA, 728 bp, Homo sapiens
  misc_feature: GZ8MTXP02H2852.39.81.H04.1.454.CMB.2.raw
  modified_base (280)..(280): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaatatggtatcgagttgggtgcgacncggcccctggacaagggtcttggagtggatggggattgggatcgagcgtacttaacgaagtgggtaccacgaaaccaaaactatacgacccaacgaacggtaaacccctaccggaacggggtcaaacggtacgggtacccaaaccacgttaccggaaacccaacgaaacgaaaccaaccgaactacccgaacgacgaccgtaacccggaccctaacgaacgttaccgggaacccgttaggaaacgggaccggtacccgtaggtaaacgtacgtaccggttacggaaccggaaaccgacccgggtccggtttaacgtacgttacgtcggtacgacggtaggaaagtacggtaaacggggtaaaatttagtttacgtacgttaccggttacccttaacgtttacgtaccgtacggtcggggaacccggtacgggtaaaaccccgttcggg

SEQ ID NO: 392399 - DNA, 642 bp, Homo sapiens
  misc_feature: GZ8MTXP02FPNQN.39.81.H04.1.454.CMB.2.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtcctccctgcccgtcacccttggacacgcccggcctccatcctcctgcaggtctagtacaaagtcctacgtatactattagatacggaaactaccttattgtaattggttcagcaagacggccaggaccaatcctacgaacggctactttaaatttaacgttaacggttaccgaaccgggtacttcggtacggggtacccagactagtacttcgaaggtcgcgtacggtcggtacacgggactaacgtagtaaacttccaactaaacgtaagtaaaactcgaacggtacgggaggggtagggacggtacgtagggtaggttaggtttagggtttaggtttacttacgtgacgtagtacggacgaaaagggtaacaccgtacgtcgacccgttacgtacgttacgttcggaccgtacggacgtagacgtagacgactaacgaagtacgtcgcgacgtcgactacacgttcgtac

SEQ ID NO: 392400 - DNA, 638 bp, Homo sapiens
  misc_feature: GZ8MTXP02GFFVJ.39.81.H04.1.454.CMB.2.raw
  modified_base (435)..(435): a, c, t, g, unknown or other
  modified_base (481)..(481): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctggagatgacgaagccgtggggcctcagtgaaggtctcctgcaaggtcttcgtggttacacctttacaactatggtatcgtaggttggtgcgacacggcccctaggacaagggtcttggagtggagtgggatggatcgagcgtacttaacgaattggtacaacaacaaaactgtgacccaacacgaacctcgagggcaaggcgtacactagtaccgaaccaacgagaaccaacaactccaacgacnccgtaaccggacctaacgagtcggaaccgtaggaacgggacaccgnggtaaacgcttacgacggaccgaaccgaccgggtcgttacgttaataccgtgtacgagtaaggagtaggtaacggggtaaatttaggtttacgaacgttccggttaacccttcgtttacgacgttacggcggggtacccgtacgggtaacccgtcgg

SEQ ID NO: 392401 - DNA, 679 bp, Homo sapiens
  misc_feature: GZ8MTXP02IPRUT.39.81.H04.1.454.CMB.2.raw
  modified_base (213)..(213): a, c, t, g, unknown or other
  modified_base (264)..(264): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagctgggcctnagtgagtctctgcagtcttctgttacaccttacatatgtatcgagttggtncgacacggccctggacaggtcttggagtggagtgggagtggatcgagtccgtacttaagaagttcggtaacctacaaaccgtaaactagtcgaccccaaccaaccggaaaccctccggaacgggtacaacgtacggtaccaaacccgtaagtacgaacccaacgtacgaaaccaacctacacccgacgaacgacccgtaaaccgacctaacgacgtacggaaccgtacggaacggaccgtaccgtaaggacgtacgtaccgtacggaaccgtaacccgacggtaccgtttagttaacgttacggttacgtacgggagaacggtacggtaaggttaacgggggtaaaatttcgttacgtaacgttccggttaccttcgtttagaccgtacgtcgggaccgtacgggtacccgtcgg

SEQ ID NO: 392402 - DNA, 662 bp, Homo sapiens
  misc_feature: GZ8MTXP02IAHQY.39.81.H04.1.454.CMB.2.raw
  modified_base (346)..(346): a, c, t, g, unknown or other
  modified_base (361)..(361): a, c, t, g, unknown or other
  modified_base (492)..(492): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgacgaaggtcttctaggttactacctttaccaactatggtatcgaggttggtgcgacgcggcccgtaggaaccgaaggtcttaggaggtggagtgggatggatcgagcgtacttanagtcgtacaacgaanaaactatgacccaacgacgaacctcgaggcagacgtaccaactacgaccgaaccaaagacaaaccaacgtaacaccgaaacgacacccgtacgtaccctagacgtcggaacctgacgactccgagaacgtntacgacgtacgaccgtacggtcgtagttaaacgttcgagtacggacgaaggtagggtaaaccggttaaacgggtaaatttacggtttacgtaccgtttaccggttaaccttgttaccggtaacgttaccggggttaccggggaaccggttaaccgggaccgtttcccggg

SEQ ID NO: 392403 - DNA, 737 bp, Homo sapiens
  misc_feature: GZ8MTXP02H4IUV.39.81.H04.1.454.CMB.2.raw
  modified_base (536)..(536): a, c, t, g, unknown or other
  modified_base (582)..(582): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcaaggtcttcgtggttactaccttacaactagtggtatcaggttggtgcgacgacggccccgtaggacgaagggtcttggaggttggagtggggatggatcgaggctacttaacgagtcggtacaacaaactaaactagtcacccaaccaacgaaccccgtaccggaggtacgacgacgtaccaaccagtaccgaacccgaacaaacgaacccaactaacgacccgaacgaaccggccgaaacccgggtccctaaagacgttaccgggaaccgttagggaaggaccgacccgttaggaacggtnttaccggaacgaacggccgaaccgggtccgttagtaactttacggngtacgaacggaaggtaacggtaaacgggttaaacggttaaaagtttacgttttaccgggtaactttaccccggtttaacccgtttaacgttacggttaaaccgttaacgggtccgggggtaaacccgtaacggggttaaacccccggtttcgggg

SEQ ID NO: 392404 - DNA, 686 bp, Homo sapiens
  misc_feature: GZ8MTXP02GOHHM.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcagtgaaggtctcctgcaaggcttctggttacaccttaccaactatggtatcgaggttgggtgcgacgacggcccctggaacaaggtcttagaggtggagtggatggatcgagcgacttaagaagtggtacaacaaacaaaactatgaccctaacgaacgaacctcgaaggaccagacgtcaaccatacgaaccaacaacgaactaacgactacccgaacggacgaccaaccggtaccctacgaacgtcggaaacccgtggaacggaccggtacctaaggaaggtacttaccgacggaaccgaacccgacggtacccgttaagtacttaccgttggacggacgtaaaaggacggtaaacggtaacggggtaaaattttccggtttaggtaaccgttacggtttaacccttaacgtttacgtaaccgttaccgggtaccggggtaaccgtaaccggggtaacccttacgggg

SEQ ID NO: 392405 - DNA, 685 bp, Homo sapiens
  misc_feature: GZ8MTXP02IZ85Z.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttactacctttaccaacttatggtatcgtaggttgggtcgacgacgacggccccgtaggaacgaacggtcttaggaggtggagtgggatggtatcgaggtcgactttaacaagttcggtaccaacgaaacaaagtactcggaccaacaacgaaccctaccgagggaccaagcgtcaaaccgtatacgaacccaacaacgaccaacactacccgaaggaacacccgacccggtactaacgacgtcgaccgagacggacgccgttagacgtactcacgggaaacgtacccgacggtcgttacggtacttacgtgaggaaccgaggacggtacgggtaaacgggtaaatttacgtttacgtaaaccgtttccggttaacccgttcgtttaacggtaaccggttccgggtaccggggtaacccgaccggggttaacccgtaccggg

SEQ ID NO: 392406 - DNA, 658 bp, Homo sapiens
  misc_feature: GZ8MTXP02JVZGA.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctctgcaggcttctgttacacctttacaactatggtatcgagttggtgcgacacggcccctaggacgaagggcttggagtggatgggatggatcgagcgtacttaacaagtcggtacaacaaacgtaaaactatcggacccaacgaacgaaccctccgaggggaccagacgtaccaaacctagtacgaacccacgaacgtaaccaaccactacccgaacgacgacccgaacccggaccctaacgagtaccgggaacccgtaggaacggaagcccgtaggaacgtactaccgaggaaccgaccgaccgggtccgttagttacgttacgtggtaggacgtaaggaggtacggtaacggggtaaatttagtttacgaacgttcggttacccttcgttacgtaccgttacggtacggggaccgaaccgggtacccgtcgg

SEQ ID NO: 392407 - DNA, 687 bp, Homo sapiens
  misc_feature: GZ8MTXP02GKNV9.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggtcttcgtggttacaccctttaccaactatggtatctaggttgggtgcgacacggccctaggacgaaggtcttgagtggagttgggatggatcgagtcgtacttacgaagtcggtacctaaacgaaacaaaactgttagacccaaacgaacgtaaacccgtccgaaggggaccaaggcgtaccaacctaagtaccgaaacccacgaacgtaaccacgaactacccgacgacgacccgacggtacctaccgagtaccggaccgtaggacggacgtacctaggacggtacttcggaacggaaccgaaccgaccgggtcccgttaggttaacttagtcgtacggacgaagggtacggtaggtaaacgggggttaaaatttacggtttacgaccgtttacgttaccccgtaagtttacaacggtttacggacgggaccggtaacggtaaccgttccgg

SEQ ID NO: 392408 - DNA, 595 bp, Homo sapiens
  misc_feature: GZ8MTXP02FRCL0.39.81.H04.1.454.CMB.2.raw
  modified_base (359)..(359): a, c, t, g, unknown or other
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgccggcctccatctcctgcaggtctagtcaaagtcctacgtatacattgataggaaacacttactgaattggttcagcagacgcaggccaatcacaagctactaattataaggttcaacgggactcgtgggccagacagacttcgagcggactaggtcgggtacnggcaacgtgtaaaattccaacaaaccttagaaaacgtgaaggacgagggggtaggagggcagggtaggtagttgggtttaggggtttaattacgtagtacgtagtaggaacgaaacgggtaacaaccgacgttacggccttaccgttaacgtacgtttcgggaaccggtacgggaacctaggacgtagggaatacgtaacaaaggacgtaaggtggacacgacaacgcttcttacg

SEQ ID NO: 392409 - DNA, 647 bp, Homo sapiens
  misc_feature: GZ8MTXP02G4NFK.39.81.H04.1.454.CMB.2.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcaaggtcttcgtaggttacctacctttaccaacttatggtatcgtaggttgggtcgcgacgcggccccgtaggacgaaggtcttggacggtggagtgggtagtggactcgacgcgtacttaacgaagttcggacaaacgaactaaacgttacacgaccaacgaacgtaaccctcggaacgggacacggtacgtaccaaacctagtaccgaacccaagaaccgaaccaacgtacgacccgaacggacgacccgtacggtaccctagacgtcggaccgtaggacggacgtaccgtagagtacgtacggacgaaccgacggaccggtcgtattacgtgtcgacgtacgagagtacggtaaggttaaacttgttacgacgtacgtaaccttgtacgacgtggacggtacgacggtacc

SEQ ID NO: 392410 - DNA, 697 bp, Homo sapiens
  misc_feature: GZ8MTXP02G7CIJ.39.81.H04.1.454.CMB.2.raw
  modified_base (445)..(445): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgggagctgagatgacgaagccgtgggcctcagtgaaggtctcgtgcaaggtcttgtaggttacctacctttaccaacgttatggtactcgtaggttggggtagcgacgacggccccgtaggaccgaagggtcttaggacgtggagtggatggatcgtagcgtacttaacgaagttggtacaacgaaactaaactatagacccaacgaacgtaacctccggaaagggacaaggtacgtaccaacctagtaccgaaacccanaacgaaccaacactacccgaacgagacccgaaccggtaccctaacgtacgtacgggaacccgtaggaacgggaacgccgttaggacgttaacgtccggtaacgaccggtaaaccggaccggttccggttagttaaaccgttgtacggtacgacggtaggacggtaaaggtaacgggttaaaatcgttttagaaccgttcggttaacccgtcgttacgtacgtacggtcgggtaacgacgggtaccgttacgg

SEQ ID NO: 392411 - DNA, 776 bp, Homo sapiens
  misc_feature: GZ8MTXP02HY18M.39.81.H04.1.454.CMB.2.raw
  modified_base (216)..(216): a, c, t, g, unknown or other
  modified_base (236)..(236): a, c, t, g, unknown or other
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtgggcctnagtgagtctctgcagtcttntgttacctaccttacatagtgtatcgtaggttggncgacgcgcccgtaggacgaggtcttggagtaggagtaggtagtggatacgaggtccgtacttaacgtagttcggtaccaactaaacctaaaacgttatacggaacccctaacgaaaccccgtaaacccgtccgggaaggaccctaagggtaccgtaccaaacctaagtacccggaacccaactaaaccgaaccctaaacccgactaccccggaaacgaccggtacccgtacccggtacctaaccggtacgttaccgggacccgttaagggaggtcctacggtgaagtacgttaccgaacggaacccggtacgtaccgggtccgtttaagtaccgttcggaggtaccggacggtaaaggtacggttaaacggggtttaaacgggttaaatttttaacgtttccgggtaaaccgttttacccgggtttaaccttttcggttaacggttaacccggttaccgggggtaccggaacccggggttttaaaccgtaccccggtttacccgg

SEQ ID NO: 392412 - DNA, 626 bp, Homo sapiens
  misc_feature: GZ8MTXP02F2G4P.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacttatggtatcgagtttgggtgcgacgacggcccccgtggaacaagggcttaggaggtggatgggatggatcgagccgtcttaacgaagtggtcaacaacgaaactagtgacccacaacgaaccctccgaggccaagcgtaccaacatcgaccaacgtagaccaacactacccacgacgacacgcctacagtacgacctaggacggacgccgtaggacgtatacgtaggaccgaaaccgacggtccgtcgtaacgttacgtcggtacgcgtaagaggtagtacggggtaaatttagtttacgtaccgttacggttaaccctcgtttacgaaccgttacggcgggtaccgtacggggtacccgttaccggg

SEQ ID NO: 392413 - DNA, 793 bp, Homo sapiens
  misc_feature: GZ8MTXP02IU8U4.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggtcttctggttactaccttacaactatggtatctaggttggtgcgacacggcccctgggacaagggtcttggaggtggagttggggatgggactacgagtcggtacttaacgtaagttcgggtaccaaccgaaacctaaaactatacggacccaaaccgaaacgtaaccctaccggaaggggaccaaacgggtacgtccaaacctacgtaccgaacccaacgaaacgaccaaccaactacccgaacgacggaacccgtaaccggccctaaacgtacgtaccgggaaccgtacggggaaacggtaccggacccgttaggaaacggtacgttaccgtacgggaaccgaaccccggtacggggtaccggttacggtttaaccgtttacggtaggtacgggacgggtaaacggtaaggggtaacggttaaacgggggttaaaacttttacggttttaacggtaaccggtttaaccgggttaacccctttcggtttaaccggtaacggtttacccggggtacgggggtaaccccgtaccggggggttaaacccctttcccggggg

SEQ ID NO: 392414 - DNA, 745 bp, Homo sapiens
  misc_feature: GZ8MTXP02G21W8.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttactaccctttaccaacttatggtatcgtaggttgggtgcgacgacggccccgtaggacaagggcttggagtggagtgggatggatcgaggcgtacttaacgaagtcggtaccaacgtaaactaaacgtagtacgaccctaacgaacgtaacccgtacgaacggggaccaaggaccgtaccaacccagtaccgaaccaacgaacgaaccaacactacccgaaacgacgaccaacccggtacctaacgagtaccggaacctagggaacggaacgtccgtaaggaacgtacgttaccgacgggaaccgtaaccggtaccgggtcccgtttaaggtaacgtttaaccggtgggtacggaaccggaaaagggtaaccggtaaaggggttaaacggggttaaaatttccgttttaaggaccgtttaccgggtttaaccccttggtttaacggtaaccgttacggggtaccggggtaacccggaacggggttaaccccgttcgggg

SEQ ID NO: 392415 - DNA, 787 bp, Homo sapiens
  misc_feature: GZ8MTXP02JTKYG.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggtcttctgttactacctttacaatatggtatcgtaggttggtgcgacgacggcccgtggacgaggtcttaggagtggagtgggatggatcgagcgtacttaacgaagttcggtacaacaaacgtaaactacgtacgaacccctaaaccgtaaccgaaccccgtccggaacggggaccgtaacggaccggttacccaaaccgacgtaacccgaaacccaaacgaaacgaaacccaccgtaccgtacccgaaaccgacgaacccgaacccggtacccttaacggaacggtacccggtaaccgtagggaaaccgggtaccgtacccgttagggaacgtacgtaccgtaccggggaaacccgtaccggtacccgggttccgttagtttaacgttaccgtcggtacgaccggtaaggaacggttaacggggttaacgggtaaacttttacggtttaacgggtacccgttttaaccggttaccccgttttaaggttaaccgttaaccgggttacccggggtacgggtaaccccggttaaaccggggtacccgtttcccggg

SEQ ID NO: 392416 - DNA, 685 bp, Homo sapiens
  misc_feature: GZ8MTXP02I97MN.39.81.H04.1.454.CMB.2.raw
  modified_base (228)..(228): a, c, t, g, unknown or other
  modified_base (274)..(274): a, c, t, g, unknown or other
  modified_base (281)..(281): a, c, t, g, unknown or other
  modified_base (304)..(304): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcngcaggcttctgttactaccttacatatgtatcgagttggtgcgacncggcccnggacgaggtctgagtggagtggntggatcgagtcgacttacagtcggtacaacaactaaactatcgactaccgacgaaccgtccgagggcaaggtacgtaccacgtaagtaccgaaccaacgaaacgaacctaaccaacgtaccccgaacgaacgtacccggaacccgaacccttacgacggttaccgggtacccagggaacggacgtacccgtggaacgtaacgttccgacggaaaccggacccgacgggttaccgttaggttaacttacgttggacgacgggaagtaaggtacggttaaaccggggtaaatttacggttttacgaccggtttaccgggttacccctttaaggtttaccgacgttaccgggtacggtaccggtaaccgggtaccgtttaccgg

SEQ ID NO: 392417 - DNA, 604 bp, Homo sapiens
  misc_feature: GZ8MTXP02FFC7M.39.81.H04.1.454.CMB.2.raw
  modified_base (274)..(274): a, c, t, g, unknown or other
  modified_base (352)..(352): a, c, t, g, unknown or other
  modified_base (446)..(446): a, c, t, g, unknown or other
  modified_base (516)..(516): a, c, t, g, unknown or other
  modified_base (580)..(580): a, c, t, g, unknown or other
tcagtcgcactagtcacgaccggtgctcgatttagtagtgtagattcgcgggccccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggcccctggacaagggcttgagtggatgggatggatcgagcgcttaacgaagtggtacaacgtaacaaaactntacggacccaacgagaaaccctccgaaggggccaaggacgtccaaaccagtcgaaccacagacaacatacccaacgagccaacgggaccctaanagtacggaccttagaggaacgcccttaggacgtatcgacggaaccgacgaccgggtccgtagtactacgngtgacgagtacgagtacgggaaattgtttacgacgttcggtaaccctgtttacgaacttacggngggaccctaacgggacccttacgg

SEQ ID NO: 392418 - DNA, 652 bp, Homo sapiens
  misc_feature: GZ8MTXP02FQ5J0.39.81.H04.1.454.CMB.2.raw
  modified_base (391)..(391): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaaggggcttgagtggatgggatggatcgagcgcttacaagtggtcaacaacaaactatgacccaacagaacctcgagggcaagcgtcaccaatcgaaccanaacgacaacactacccaagacgaccaaccgggaccctaacacgtacgggaccctagggaacggacgtacccgtggaaagtattaccgtaaggaccggaaccgtaccgggacccgttaagtttaaccttaacgtggttacggacggtaaggaggtaaggtaacgggggtaaaatttacgtttttacggaacgtttcggttaacccctttgtttacgaaaccgttacggtacgggggacctaacgggggtaaccctttccggg

SEQ ID NO: 392419 - DNA, 602 bp, Homo sapiens
  misc_feature: GZ8MTXP02IR6LA.39.81.H04.1.454.CMB.2.raw
  modified_base (271)..(271): a, c, t, g, unknown or other
  modified_base (274)..(274): a, c, t, g, unknown or other
  modified_base (566)..(566): a, c, t, g, unknown or other
tcagtcgcactagtcacgaccggtgctcgatttagtagtgtagattcgcgggggatcaggactcctcagttcaccttctcacaatgaggctccctgctcagctcctggggctgctaatgctctgggtcccaggatccagtggggatgttgtgatgactcagtctccagtcctccctgcccgtcacccttggacaggcccggcctccatcctcctgcaggtctagtcaaagcctgtaatacattgataggaaactcctacttgaattggttnagnagaggccaggccaatcctaccaaggctaccttaaattacgtaaaggtttaccaaccggggtcttcgtcgggtacccaagcagattcagcgcaggtggacagcatagattccaccataagaaactcgagtacgagggggtcgaggcgtaggaggttagttgggttacgggtttattacgttgtacgtagtagaacgaaagggaaccaactaccggttcgtacccgttaccgttaacgttacgttcgggaaccgacggggtaacaaacggcgtacggagactacgaaacgtaancggtaagtcgtagacgtactcgttacttcgttaccc

SEQ ID NO: 392420 - DNA, 721 bp, Homo sapiens
  misc_feature: GZ8MTXP02GMQCU.39.81.H04.1.454.CMB.2.raw
  modified_base (215)..(215): a, c, t, g, unknown or other
  modified_base (271)..(271): a, c, t, g, unknown or other
  modified_base (334)..(334): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctnagtgagtctctgcaggtcttcgtgttactaccttacaatatgtatcgtaggttggncgacacggcccctggaacgaagggtcttggaggtggagtgggatggatcgaggcgtacttaanaagttcggtaccaacaaactaaactatcgaacccaacgaacgaaccctcggaagggacaagtacgtaccaaacacgtaccgaacccaacgaaacgtaacccaaaccacgtaacccaacggaacgacccgaaacccggtaccctaacgaacggtccggtaaccgtagggaacggaacggtccctaaggaacgtacgttccgacgggaaccgaacccgtaaccgggttcccgttagttaaacttcggtaggtacggaacggtaaggtaaggttaacggttaaacggggtaaaattttcgttttacggaaacggtttccggttaacccgttgtttaaccggaacggtttaaccgggcgggggtaacccgaaaccgggttacccgttacgg

SEQ ID NO: 392421 - DNA, 707 bp, Homo sapiens
  misc_feature: GZ8MTXP02J2M97.39.81.H04.1.454.CMB.2.raw
  modified_base (287)..(287): a, c, t, g, unknown or other
  modified_base (427)..(427): a, c, t, g, unknown or other
  modified_base (480)..(480): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgaggtgaaggtctcctgcgaaggtcttcgtcggttacctacctttaaccaactatggtatcgtaggttgggncgacacggcccctaggaacgaagggtcttaggaggtggagtgggatggatcgagcgtacttacgaacgttggtaccaacaaccaaaactgtacgaacccaacgaacgaaccctacggaggacaacgcgtaccaaacgtanaccgaaccacgtacgacaacaccaccgaacgacgacccgaaccggtcctaacncgtacggacctagggacggaacgccgtaggacgtactacgacgggaacaccgaccgggttacgttaggttaactttccggaggtacggacggtaaggtaacggtaccgggttaacgggggttaaaaacttttcggttaccggaacgttttaccggtttaacccgttcggtttaacgaccgggtttacggtaccgggggtacccgtaaaccggggttaccccgtccgg

SEQ ID NO: 392422 - DNA, 601 bp, Homo sapiens
  misc_feature: GZ8MTXP02GAKAU.39.81.H04.1.454.CMB.2.raw
  modified_base (212)..(212): a, c, t, g, unknown or other
  modified_base (251)..(251): a, c, t, g, unknown or other
  modified_base (265)..(265): a, c, t, g, unknown or other
  modified_base (320)..(320): a, c, t, g, unknown or other
  modified_base (342)..(342): a, c, t, g, unknown or other
  modified_base (372)..(372): a, c, t, g, unknown or other
  modified_base (475)..(475): a, c, t, g, unknown or other
  modified_base (488)..(488): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggttcccactcccaggttcagctggtacagtctggagctgagatgacgagcgtgggcctnagtgagtctcctgcagcttcgtgttactaccttacactntgtatgtaggtggncgacgcgccctggacgtaggctagaggtggagtcgggatgactcgagctacttanacgtgtacacaaactaaacgtnacgacaacccgacgaccgcgagacacgacnccacacgacaccaactacgaccacacgaccgacgaccgacgtacgacacgtacgacgacggaggacgcgtacgagacgactacggaccgacgtacgtacggtntaacgtagtcggngacgaggagtacggtaacgggttaaggtaatttacggtacgtaccgttaccgttaccttacggtaacggtaaccgttacgggacggaaccggtaccggtaccgttccgtaccg

SEQ ID NO: 392423 - DNA, 763 bp, Homo sapiens
  misc_feature: GZ8MTXP02G8ZZ1.39.81.H04.1.454.CMB.2.raw
  modified_base (288)..(288): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggtcttcgtggttacctaccttaccaacttagtgtatctaggttgggtgcgacncggccctggaacgtaggcttgaggtggaggtgggatggatcgacgcgtacttacgaagttcggtacaaaccgaactaaatagtacgaccccaaccgaacgtaacccgtaccggaaggggaccaaacggtacgtacctaacccgtacgtaccgaaacccaacgaacgaaacccaaaccgtaacctacccggaaacggaacgtacccgaacccgtaacccgtaaccgaacggttaccggtaacccgtaggaaacgggaccgtccgtaggactacgtacgtacggaaccggtaccgacggtaccggttagtaacgttacgtaggtcggtacggaaaggtacgtaacggggttaaacgggttaaaacgtttcggttttaacgtaccgtttaaccggtttacccccgtttaaggttaccggttaaccggttaccggggttaccgggggaacccgttaacggggtaaccccgtttccgggg

SEQ ID NO: 392424 - DNA, 677 bp, Homo sapiens
  misc_feature: GZ8MTXP02HO06D.39.81.H04.1.454.CMB.2.raw
  modified_base (199)..(199): a, c, t, g, unknown or other
  modified_base (275)..(275): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtcctccctgccccgtcacccgttggacngccggcctccatcctcctgcaggtctagtcaaagcctcgtatacattgaataggaaactactactgtaattggttnagcgagacgtccagaccaatctaccgaaggccgtaccttaaatttagtaacggtttaccgtaaaccgggtactcgtcggggtacccaaggacacgtaattccgaagtccggcgtaggttcgggtacgtacgggactaacgttagtaaacttaccgaaacttaactaaagtaaaaactccgaaaggtaccggaagggggttaggtaaggcgttaaggtaagggtaagtttacgggtttaggggttttaattacggtagtacgttaagtagacggaaaagacgtaaccgacgttcgaccgttaccgtaccgttacgtttaccggcgtaaacgggggtaccaaaggtcgtagaacgtaactaccgaaaagaaccgtggtacgtcgacgacctaaccgtgttaccg

SEQ ID NO: 392425 - DNA, 735 bp, Homo sapiens
  misc_feature: GZ8MTXP02JW238.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctctgcaaggtcttcgttcggttacctacctttaaccaacttattaggtacttacgtaggttgggtgacgacgacggcccctaggaaccgaagggtcttggaggtggagtgggagtggatcgagtcgtacttaacgagtcggtaccaacgaaacaaactcgtacgacccaacacggtaaccctacggagggacaagaccggtaccaaaccgtagtaccgaaccaacgaacgacccaacaaccgtacccgaaccgacgacccgaaccggtccctaacgtacgttacgggaacctagggaacgggacgtccgtaggaacgtacgttaccggtaacggaacccggtaccggtacccgggtaccggtttacgttaacgtttaccggtgggtacggacggtaaggaaacgggtacgggttaaacggggtaaattttacgtttacggaaccgtttcccgttaacctttcgttacgtaccgtaccgggtcgggaccgtaaaccggtccgtacccgg

SEQ ID NO: 392426 - DNA, 634 bp, Homo sapiens
  misc_feature: GZ8MTXP02GYODZ.39.81.H04.1.454.CMB.2.raw
  modified_base (440)..(440): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaaggcctggggcctcgagtgaaggtctctgcaaggtcttcgtggttacctaccctttaccaacttagtgttatcgtaggttggggtgcgacgacggcccctggaacgaggcttggagtggagtggggatggatcgagtcgtacttaacaaggttcggtaccaacaaacctaaactagtcgaacccaacgaccgaaccctcgacggacgagcgtaccacagtaccacgacaagacacctanacccgagacaccgtaaccggccaacgagtacggaaccgaggaacggaccgtcccgtaggaacgtacgttcgacgggaaacccgtaccgaaccggggtccttagttaactcgtgcgacggtagacgaggttacgggatttacgttgtaacgtcgttaccttgtactacgtacgcggaccgtacgggtaccctcgg

SEQ ID NO: 392427 - DNA, 721 bp, Homo sapiens
  misc_feature: GZ8MTXP02JIBEB.39.81.H04.1.454.CMB.2.raw
  modified_base (279)..(279): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctggtacagtctggagctgagatgacgagccgtgggcctgagtgaggtccctctgacgaggtcttcgtgttacctaccttacaatatggtatgtaggttgggngacgacgacggcccgtaggaacgaggtcttaggaggtggagtggagtggatcgagtcgtacttaagaagttcggacaacaaactaaactacgtagaaccccaacgaaccgtaaacccgtaccggaagggacaacgtaccggtaccaaaccgtacgtaaccgaaacccaaacgtaaaccggaacccaaacgtacccgaaacccgaacgaaaccgtacccgaacccgtactaccgtaggtacccggaccgtagacggacgtcgtaggaagtcgtaccggagaaccgtacgaccgggttacgttacgttagttaccggtggtacgacggaaggtaaacgttaaggggtaaacgggttaaaattttacggtttcgaaccgtttccggttaaccttgtttaacggaccgtacgggtaccggggtaccgtaaaccgggtcgttaccgg

SEQ ID NO: 392428 - DNA, 617 bp, Homo sapiens
  misc_feature: GZ8MTXP02JHX47.39.81.H04.1.454.CMB.2.raw
  modified_base (288)..(288): a, c, t, g, unknown or other
  modified_base (406)..(406): a, c, t, g, unknown or other
  modified_base (483)..(483): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtgcccactcccaggttcagctggtacagtctggagctgagatggacgaagccgtgggcctcagtgaagtctctgacgaaggtcttcgtagttacctaccctttaacaacttagtggtatcgtaggttgggngcgtacgcggtcccctgggaacgaagggtctaggaggtggagtgggatggatcagcgtactaagaagtgtacaacgaataactagcaccaacaacgacctcggaggcagcgtcactanaccgaccaagacgacctaacacacccgaacgacgaccgtaacggaccctaacgacgtaacggactagggaacgaacncgttaagggactacgtcgacggtaaaccgcgtaccggtacgttagtaacgttcgagagacggaagtagtaggtaacggtattacgttacgaccgtcgttactgtacgactcgggacggaccggacggtccgtcg

SEQ ID NO: 392429 - DNA, 716 bp, Homo sapiens
  misc_feature: GZ8MTXP02GVFMP.39.81.H04.1.454.CMB.2.raw
  modified_base (276)..(276): a, c, t, g, unknown or other
  modified_base (281)..(281): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatcagttgggtncgacnggcccctggacaaggctgagtggagtgggatggatcgagcgtacttacaagttcgcaaaccaactaaaactatggaccaacacgtaaccctccgaagggctaagcgtaccaacctataccgaaccaacgagaacccacgactacccgaacgacgcccgtaaccggaccctaaccgacgtcggaacccgtaggacggacgtcccgtaggacgtacgtaccgtacggaaaccgaccgtaaaccgggtccggtttaacgttacgtttaaccgtgggttacggaccggtaaggtaaacggtaaaggggttaaccgggggttaaaaattttacggttttacggtaaccgttaaccggtttaaccccgtttcgtttaaccggtaaccgttacgggggtacccggggtaaaccgggtacccggggtaaaccccgtttccggg

SEQ ID NO: 392430 - DNA, 682 bp, Homo sapiens
  misc_feature: GZ8MTXP02HKNGG.39.81.H04.1.454.CMB.2.raw
  modified_base (275)..(275): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctctgcaggcttcgtgttacctaccctttacaactatgtatcgtaggttggngacgacgacggccccgtggaacgagggtcttaggaggtggagtgggagtggatcgagtcgtacttaacgtagtcgtacaaacgtaaactaaactagtacgaccaacctaacgtaaccctacggaaggaccgtaaggtacgtaccgaaaccacgtaccgaacccaaacgaacgaaccaacctacacccgaagacgcgaacccgtactaacgacgtacgaccgtaggacgtacgtccgtagacgtagtcccgaggaccaccggtccggtacgttagttacggttaccgtggtagaccgaaaggtacgggttaaacggtacggggtttaaattacggttcgtaaccgtttaccggtactttaacgtacgtacgttaccggtacggggaccgtaccggttaaccgttccgg

SEQ ID NO: 392431 - DNA, 702 bp, Homo sapiens
  misc_feature: GZ8MTXP02JB6AN.39.81.H04.1.454.CMB.2.raw
  modified_base (275)..(275): a, c, t, g, unknown or other
  modified_base (280)..(280): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacncggcccctggacaaggcttagagtgagtgggatggatcaaggcgtacttaacaagtcggtacaacgaactaaaactagtcgaccccaacgaaaccgtaaccccgtacgaaggggcctaaagcggtacctaaaccaagtacgaacccaaacgacgaaaccaactacgacccgacgaacgccgtaaccgaccctaaccgaataccggaccgaggaacggtacgaccgtaggaacgtacgtaccacgggaaaccgacggaaaccggggtaacccgttgttaaacgttacccgtggtacggaccggaacggaaggtacgggtaacggggtaaaatttaggtttacgaacccgtttcggaaaccccgtttgttacgtaaccgttaacggggtcggggtaacccgtaacggggtaaccccgttccggg

SEQ ID NO: 392432 - DNA, 791 bp, Homo sapiens
  misc_feature: GZ8MTXP02GSBNX.39.81.H04.1.454.CMB.2.raw
  modified_base (216)..(216): a, c, t, g, unknown or other
  modified_base (227)..(227): a, c, t, g, unknown or other
  modified_base (256)..(256): a, c, t, g, unknown or other
  modified_base (264)..(264): a, c, t, g, unknown or other
  modified_base (270)..(270): a, c, t, g, unknown or other
  modified_base (275)..(275): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtgggcctnagtgagtctcngcaggtcttcgtgttactaccttacaatntgtatcgngtggtncgacncggcctggaacagggcttggagtggagtggggagttggatacgagcgttacgtaactaagtcggtacaaacaaacgtaaactagtcggaccaaccaacgtaacccgtaccggaacggggtaccaaagggacccggttaaccaaaacccgttacgtacccgaaacccaaacgaaccgtaaacccaaacgttaccctaaacccggaaaccgggaacgtaacccggaaacccggtaaccctaaaccggtaaacgttccggggaaaccccgttaggggaaacggtaccgggtaacccgttaagggaacggttaaactaccgggttacgggaacccgtaaaccgggtacccgggtaccggtttaacgttaacgttcggttacggtagggaaccggtaaaggtaagggttaacgggttaaacgggttaaaatttacggtttacgtaaaccgttccggttaacctttcggttaacgttaccgttacgggtaccgggtaccggtaaccgggttacccgtaccgg

SEQ ID NO: 392433 - DNA, 659 bp, Homo sapiens
  misc_feature: GZ8MTXP02GD8XI.39.81.H04.1.454.CMB.2.raw
  modified_base (368)..(368): a, c, t, g, unknown or other
  modified_base (575)..(575): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacaccgtttacaactatggtatctaggttgggtgcgacacggcccctaggacgaagggtcttggacgtggagtgggatggatcgagcgtacttacaagttcggtaccaacgaaactaaaacgtntacgacccctaacgacgtaacccgtccgaaggggccaaggtcggtaccaaccgtaacgtacgaacccaacgaacgaaccaaaccgtacgtaaccccgacgaacggaccgaacccgggtaccctaaacgtacgtacgggtaaccgtagggaacggacggaccgtaggacgtacgtctacgggaccaccggacgtcgttagtacttcgngtgacgagacgtagtacgggaaattcgttagacgttcgttacctgtttacgacgttacggagggacctacgggtaccgtaccgg

SEQ ID NO: 392434 - DNA, 731 bp, Homo sapiens
  misc_feature: GZ8MTXP02I2ZP5.39.81.H04.1.454.CMB.2.raw
  modified_base (398)..(398): a, c, t, g, unknown or other
  modified_base (471)..(471): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctcggttactaccctttacccaacttatggttactcgtaaggttcggggtgcgtacgaccggcccctagggaccaaggggtccttaggaggtagggagttggggagtggtagtcgaaggccgtacgttaacaaagttcggtacaacaaactaaaccgtntacgacccacacgaaccctcgaaggggcaggacgtccaaacccagtacgaacccacgaacgtaccaaccaacncccaacgaacgaccgtaacccggacctaacacgttcggaacccgtgggaacgggacggaacccgttaggaacgttactccggtaggaaccgaacccggtaccgggtcgtaacggttagtttaccggtggtacgaggtaacggtagggtaaacgggttaacgggttaaatttacggtttacgtacggtttaccggttacctttcgtttacggtaaccggttacgggtaccggggtaacccggtaccgggttaacccgtcgg

SEQ ID NO: 392435 - DNA, 649 bp, Homo sapiens
  misc_feature: GZ8MTXP02FT2TS.39.81.H04.1.454.CMB.2.raw
  modified_base (216)..(216): a, c, t, g, unknown or other
  modified_base (416)..(416): a, c, t, g, unknown or other
  modified_base (475)..(475): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnagtgaaggtcctctgcaaggtcttctggttacctacctttaccaattagtggtatcgtaggttggtcgcgactacgggcccccgtaggaacgaaggggtcttaggaggtggagtaggggatgggactcggagcggtacttacgaagtcggtacaaccaataaactgtacacacaacgacctcgaggtcagtcgacacganacgaccaactacgacacacaccgaacgacgtccgaccgacctaagacgtacgggaccgnggaaacggctacccgtaggacgtacttcggaacgacccggaccgacggttaccgttagttaacgttcgtgtacggacggtaggaggtaccggttaaagggtaattttacgtttacgaccgtttcggtaaccttaggtttacgacgttcgggaccggaccggtacgggtaacccg

SEQ ID NO: 392436 - DNA, 951 bp, Homo sapiens
  misc_feature: GZ8MTXP02GTGQS.39.81.H04.1.454.CMB.2.raw
tcagtcgcactagtcacgaccggtgctcgatttagtagtgtagattcgcggggactgatcaggactcctcagttcaccttctcacaatgaggctccctgctcagctccgtggggctgctaatgctctgggtcccaggatccaggtggggatgttgtgatgactcagtctccagtcctccctgcccgtcacccttggacacgccgcctccatcctcctgctaggtcctagtcaaagcctacgtatacattgagtacggaaacctccttacttaggtaaattttgggttaccaggaccaaggacgggaccccaaacggggacccctaaaacgttccgtaaccccggaaaacggggtcccgttaaacccttttaaaaggtttttaaacgttaaaaccgggggttttttaccccgtaaaaaccccggggtaccgttttaccgggttaaccggggggttaccccccaaaggggtaaacctaaccgggttaactttacccggaacggggtccccgggacggttaaggggttcggggtaccgtaacgggaccctaaaccggttacgtaaacgtttaccccaaagtaacccggttaaaaacgtaaaacgtaccggaaagggtaccggggtaagggggttacggggtaaggtacggttaagggttaacggggttaggtttacgggggttttaagggggttttaaactttaacggtacggtaacgtaaaggtaccgggaaaaccggtaaaaccggtaaaccgtaccgttaaccggtacccgggttaaccccgttaacccggtttaaaccggtttaaccggggtttaccgggaaacccgggtaaacggggttaaacccgtaaacggtacggtaaacggtaaaccggtaaaaccttaaaaccggtaaaacccgggtaacggttacgggaacggttacctaccgaaccctaaacgttacgttcg

SEQ ID NO: 392437 - DNA, 681 bp, Homo sapiens
  misc_feature: GZ8MTXP02FIM8J.39.81.H04.1.454.CMB.2.raw
  modified_base (303)..(303): a, c, t, g, unknown or other
  modified_base (348)..(348): a, c, t, g, unknown or other
  modified_base (362)..(362): a, c, t, g, unknown or other
  modified_base (387)..(387): a, c, t, g, unknown or other
  modified_base (398)..(398): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggtagcaacaacaggtgcccactcccaggttcagctggtacagtctggagctgagatgacgaagcctgggcctcagtgaagtctctgcagcttctgttaccaccttacaatatggtatcgaggttggtgcgacgacggccctggacgaaggcttggagtgagngggatggatcgagcgtacttaacgagtcgtacaacaactaaactngacaccgacgaccncgaggcagacgtcacatcgaaccanagaaccatacnccgaacggaacgaccgtaccgacccgtaacgacgtacggacgtaggacggacgtaccgtagacgtacttacgaccggtaacgaccgtaaccggtccggttagttaacgtttacgtaggtaggaccggaaggtaaggtaaacgggttaaaccgggggtaaaattttacggtttaaacggtaacccggtttaccggtttaccctttaacggtttaaccggtaccggtttaaaacccgggcgggggtaaacccggttaaccgggaacccgttaccggttaccccgg

SEQ ID NO: 392438 - DNA, 612 bp, Homo sapiens
  misc_feature: GZ8MTXP02HQBL7.39.81.H04.1.454.CMB.2.raw
  modified_base (349)..(349): a, c, t, g, unknown or other
  modified_base (377)..(377): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagtgggtgcgacaggcccctggacaagggctgagtggatggggatggatcaggcgacttacaagtggtacacaacaaaacttancgaccacaacgaacctcgaggggcaggntaccacatcgaaccacgaagacaacatcccaacgagaccgacgccctaacgatacggacctggacggaacgcctaggaacgagttcgacggaaccgacgaccgggccttaggttaacttacgtcggtagacggtaggacggtaagtacgggggtaaaatttacgtttacgtacgtcgggttacccttcgtttcgaacgttacgtagggggtacccaacggggtaacccgttcggg

SEQ ID NO: 392439 - DNA, 739 bp, Homo sapiens
  misc_feature: GZ8MTXP02JEBA1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttacactatggtatcgagttgggtgcgacacggccccgtggacgaggcttggagtggagtgggagtggatcgaggcgtacttaacgaaagttcggtacaaaccacgaaaacttagtacgaccccgaaaccaacgaaacccctcccggaaggggaccaagggccgtacaacctaagtaccgaacccaacaaaggaaccaaaccaacgtcccgaaacgacgacccgaaacccggtaccctaacgaacggtacggtaaccgacggggaacgggacgtacccgtaggaacgtaacgttcccgaagggaaacccgacccgggaaccggtacccgggttaagtttaaaccggtttacgtacgggtacggacggtaaggtaacggggtaaggttaaaccgggggtaaaattttacggtttttacgaaccggtttcggttaacccgttgtttacgaccgtttacgggacggggtacccgaacggggtaccccgtacggg

SEQ ID NO: 392440 - DNA, 635 bp, Homo sapiens
  misc_feature: GZ8MTXP02I8G05.39.81.H04.1.454.CMB.2.raw
  modified_base (377)..(377): a, c, t, g, unknown or other
  modified_base (486)..(486): a, c, t, g, unknown or other
  modified_base (527)..(527): a, c, t, g, unknown or other
  modified_base (534)..(534): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggccagcaacaacaggtgcccactcccaggttcagctggtacagtctggagctgagatgacgaagccgtggggcctcagtgaaggtctcctgcaaggtcttcgtgttacctacctttacaatagtggtatcgtaggttgggtcgcgacgacggccccgtaggaccgaagggtcttaggaggtaggagtgggactggatcgagcgttcttaacgatcggtacaaccgaaactaaacctncgacccaaccgacgaaaccctccggaggtacagtctaccgactagcgaaccagaataccacgacctaccgagacgtcgaacgacctacgatacggacctagacggtacnccgtagcgtatcgacgaacgccgaggccgtatactgtacgnacgaagnggttaagtaccggggttaaattaaggtttcgaaccgttccggtttaacccttggttaacgtacgttacgggtaccggaccgtaaccggtaccgtttaccgg

SEQ ID NO: 392441 - DNA, 848 bp, Homo sapiens
  misc_feature: GZ8MTXP02II0OH.39.81.H04.1.454.CMB.2.raw
  modified_base (222)..(222): a, c, t, g, unknown or other
  modified_base (233)..(233): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcggtctccacgtctcctcgcccgtcctaccttcggacacgccggcctccactcctcctacnggtctacgtanaacgacctcgtatactattgataggaacacctacttagtaattggttctagccaggacggacccgaggtaccaaatccgttaccccaaacggggtactaccccttaaattttaacgttttaaaacgggttttaccccgtttaaaccgggggtaacccgtttccgttaccgggggtttacccccggttaaacgaaacggttaacgtaacgtttacccgtaccggaaaccggggttcgtaaccggtagggggtttcccaaccgggggtccgaacccttaggggttaaaaacctttccgaaaacaacccgtttaaaaggaaaacttactaaccggtacggaacggggttaagggaccggtacgtaggggtaggttaaacggtttgggtttaaggggtttaccgttaagttaaccggggttacgtacgtacggaacgtaaccgggaaccgtaaccgtaccggtaccggtacccgtttacccggtaaccgttacgttaccgggtaccggaaacgggtaacccgtaacggtacggtaacggaaacggtaacgtaaacgtaaccgtaaccgttaggtaaccggtacgtaccgtaccgtaccgtaccgtacgttacgttaccg

SEQ ID NO: 392442 - DNA, 650 bp, Homo sapiens
  misc_feature: GZ8MTXP02JL5DM.39.81.H04.1.454.CMB.2.raw
  modified_base (476)..(476): a, c, t, g, unknown or other
  modified_base (501)..(501): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgagttgggtgcgacgacggcccctggacgaaggcttaggagtggagtggggatggtatcgaagcgtacttacgaaagttcggtacaacaaactaaactatcgaccaccgaacgtaccctaccggagggaccaaggtacgtaccaaaccgtagtaccgaaccctacgaaacgaccaactacacccgaacgacgacccgaaccggaccctanaaccgttcggaacttcggacggacnccgtagaagttacacggtacgaaccgaccggacggtcgttagtaacttaccgtggacgcggtaaagacgtaaggacggtaaattacgttacgacgttccgtaaccgttgtacgtaccgtacggtacgggacccgtacgggaccttccgg

SEQ ID NO: 392443 - DNA, 780 bp, Homo sapiens
  misc_feature: GZ8MTXP02G8HZY.39.81.H04.1.454.CMB.2.raw
  modified_base (514)..(514): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccactcccaggttcagctggtacagtctggagctgagatgacgaagccgtgggcctcagtgaggtctcctgcaaggtcttctggttactaccttacaactatggtatcaggttgggtgcgacgacggccccgtaggaacgaaggtcttgaggtcggagttggatagggatcgaagcgtacttaagtaagtggtacaacctaaacaaacgtagtacgaccccaacgtaaccggaaccctacggaggtacgaagtacgtaccaactagaccgaaaccacgaaagtaccacaactccgaacgacgcgaaacccggtctaagactagggaccctaaggggcgaacgtccgtgaaacggttanacccggtaggaaacccgacggtaaacccgggtccctttaaagggttaaccttaacgtttccgggtaggtaaacccgggaagggttaaaacccgggaacggggtttaaaacgggggttaaaaatttttaacggggttttaaccggttaacccggttaccgggtttaaacccccggtttaagtttttaaaaccggacccccggtttaaacgggggttaaacccccgggggaccccggttaaaaccgggtaacccccggttttacgggg

SEQ ID NO: 392444 - DNA, 666 bp, Homo sapiens
  misc_feature: GZ8MTXP02JO91V.39.81.H04.1.454.CMB.2.raw
  modified_base (360)..(360): a, c, t, g, unknown or other
  modified_base (367)..(367): a, c, t, g, unknown or other
  modified_base (398)..(398): a, c, t, g, unknown or other
  modified_base (544)..(544): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctgttacacctttaccaactatggtatctaggttggtgcgacgacgccccgtggaaccaagggtcttgaggtggagtgggatggatcaggcgacttaacagtcggtacaactaacaaactntacacanacaacctcgagggcagaacgtcaacccgtanacgaccaacgtacaacacacaccgaacgagacccgaccggtacctaacgagttaacgggaccgtacggacggaccgttaccgaggacgaacgttccgaaggaacccggacgaaccggggttcccttagggtttaaactttaccggngtaccggacggaaaaggttacggaaaggtttaaaccgggtaaaattttcgtttaacgacggtttaccggttaaccctcggtttacgaccggttacggttcggaacccggtaacggtaccccg

SEQ ID NO: 392445 - DNA, 700 bp, Homo sapiens
  misc_feature: GZ8MTXP02GYWWC.39.81.H04.1.454.CMB.2.raw
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccaggtggggatgttgtgatgactcagtctccagtctccctgcccgtcacccttgacacgccgcctcatctctagctagtctagtacaaacgtcctacgtatactattgaagtacggaaactaccttacttagtaaatttggttacagtaccgaaggacggacccaaggaccctaaagttcctaaccgaacggtccgttaacctttaaaattttaacggttaaacggtttttaccgtaaacccgggtactttaccggtcgggggtaccccaaaggaactaacggtacttaccgaaggcggtacgtaaggttcgggtcgaacggtctacgttagtacttacaactacgtaaagaatacgaggacgaggggtagacggagtaggtaggtacgttgggtttaggtttaacgttcgtagtacgtatagggacgaaaaggtaacctaacgtacggtacggtcccttaccggtaacttcggtttacggaccgtacggggaactacggtcaggggtacaaacgtacgtaaaacgtaacgtacggtacgtcgagacccaacgttacttcg

SEQ ID NO: 392446 - DNA, 700 bp, Homo sapiens
  misc_feature: GZ8MTXP02GW2L7.39.81.H04.1.454.CMB.2.raw
  modified_base (325)..(325): a, c, t, g, unknown or other
  modified_base (600)..(600): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaagtctcctgcaggcttcgtgttacctacctttaccaatgtgtatcgtaggttgggtgcgacgacggcccgtaggacgaaggtcgtaggagtggagtgggagtggntacgagcgtacttaacgtaagtcggtacaaccaaacgtaaaacagttacgacccaacgaaccgtaaccgtacccggaggtaccgagacgttccaaacgtaacgacgaaaccaaacggaaacaacgtaacaacaccccggacgaacgacccgaaccgggtacctaaaccgtacgtaacgggtaaccgtacggacgggtaaacgtccgtaaggaacgaccgttacgaaccgggaacgaccggaacccgggttcgtttaacggttattaccggtaggngtaaccggagtaacgtaggaacgggttaaattagtttacgacggttacgttccgtaagttccgtacgtcgggtacggtacggtaccggtaacggttccgg

SEQ ID NO: 392447 - DNA, 686 bp, Homo sapiens
  misc_feature: GZ8MTXP02GJQT5.39.81.H04.1.454.CMB.2.raw
  modified_base (577)..(577): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtgggcctcgagtgaaggtctcctgcaaggtcttcgtaggttactacctttacaactagtggtatcgtaggttgggtgccgacgacggccccgtaggacaagggtcttaggaggtaggagtggggaatggaactcgagcgtacttaagtaagtcggtaccaaacaaacgaaactactgaccccaaacaacggtaacccctacggaacggacgaagacgttaccaaaccgtagtaccgaccgaaacacgaaacccaacacgacccaagacgacccgaacggtacccagacgtaccgaccgtaggaacgagcctagaagaacgtcacgggaaccaccggttaccgacggttagtaaaccgttgacggtacgnggtaaagaccggtaggggttaaaccggtaaatttacggtttacgtacgtccggttacccttggtaacgtaacggtcggtacggggtaccccgtaagggtccccggttag

SEQ ID NO: 392448 - DNA, 621 bp, Homo sapiens
  misc_feature: GZ8MTXP02JA9F7.39.81.H04.1.454.CMB.2.raw
  modified_base (481)..(481): a, c, t, g, unknown or other
  modified_base (535)..(535): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaacggtctcctgcaaggtcttctggttactacctttaccaactatggtatcgagttgggtgcgacaggcccctggaacgagggcttggagtggagtgggatggatcgaggtcgacttacgaaagttcggtacaacgaaactaaaactagtcgaccaaccgacgaaccctccgagggacagacgtccaacgtatacgaaccacgaacgaccaacacgtaccacgacgccaccggacctaccgagtacggacctaggacggacnccgtagagtatcgtagaacccgacaccgggtacgtagttacgttacgtggacgngaagtagaggtaacggggaaattacgtttacgacgttcggttaccctgtttacgacgtacggtcgggtacgacgggtaccctacgg

SEQ ID NO: 392449 - DNA, 604 bp, Homo sapiens
  misc_feature: GZ8MTXP02FXTMY.39.81.H04.1.454.CMB.2.raw
  modified_base (237)..(237): a, c, t, g, unknown or other
  modified_base (269)..(269): a, c, t, g, unknown or other
  modified_base (307)..(307): a, c, t, g, unknown or other
  modified_base (324)..(324): a, c, t, g, unknown or other
  modified_base (509)..(509): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagcgtgggcctgagtgagtctcctgcaggtcttntgttacaccttacaatatgtatcgtagttggncgacgacggcccctggaacgaggtcttgagtggatggngtgatcgaggctactanaagtcggtacaaacacaaatgtacgacccaacgaaccgaacccgtcgaggacagaccgtacaacagtaccgacctaagacgaacactacacccgagacgtaccgaccgtacaacgtacgacgtaccgaggacgtacgaccgtagacgtctacgcggaaccaacggacggtcgtagttacttacgngtcgagagaggtacggttaaggtaaattcggttcgtacgttccgttaccttgttaccgaaacgttccggtacggaccgaacggtacccgttacgg

SEQ ID NO: 392450 - DNA, 677 bp, Homo sapiens
  misc_feature: GZ8MTXP02JY92C.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctccgtgcaaggtcttcgtggttacctacctttaccaacttagtggttatcgagttgggtgcgacacggcccctaggacgaacgggtcttaggacggtaggagtgggtagtggtatcgaaggccgtacgttaacgaagttcggtacaaccgtaaactaaaacgttgtacgaccaacgaacgaacccgtaccggaggtacaaggtactaccgacctagtccgaaccaacgacgaccacacgtaccacgacgacacccgtactacgagtacggactagacgacgccgtagaacgcgttacgacgggaacccgacgacccggtccggttagttaacgttaccggtagacgtcgaggtacgaggtacgggtaaaatttgtttacgaccttacgggttacctaacgtttacggtaccgttaacggttccggggaccgttaacgggtaacccgttcgg

SEQ ID NO: 392451 - DNA, 557 bp, Homo sapiens
  misc_feature: GZ8MTXP02J3SF2.39.81.H04.1.454.CMB.2.raw
  modified_base (250)..(250): a, c, t, g, unknown or other
  modified_base (262)..(262): a, c, t, g, unknown or other
  modified_base (267)..(267): a, c, t, g, unknown or other
  modified_base (330)..(330): a, c, t, g, unknown or other
  modified_base (359)..(359): a, c, t, g, unknown or other
tcagtcgcactagtcacgaccggtgctcgatttagtagtgtagattcgcggggactgatcaggactcctcagttcaccttctcacaatgaggctccctgctcagctcctggggctgctaatgctctgggtcccaggatccagtggggatgttgtgatgactcagtctccagtctccctgcccgtcaccttggacagccgcctccatctcctgcaggtctagtcaaagcctcgtatacattgatggaaacnctatgaattgtngcagngcagccaatctcagctactaattatacggtctacggctcgcgggtccagacagattcgagcgnacggtgggtccaggctactgaattcaaanctaagaaaactcgaagcgagggtgaggtctagaggtaagttggttagggtttatacgtgactagtagacgaaaggacacgtaacgtcgtaccgtaccgttacgtaacgtttcggaccgtaacgggggaccaaggtacgtacggagaacgttaaccgaaaaacggccgttaggcggtactacggacctactactttccg

SEQ ID NO: 392452 - DNA, 661 bp, Homo sapiens
  misc_feature: GZ8MTXP02G673A.39.81.H04.1.454.CMB.2.raw
  modified_base (536)..(536): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtggggcctcagtgaaggtctcgtgcaaggcttctgtactaccttacactatgtatctaggtggtgcgacgacggcccgtaggacgaagggcttaggagtggagtgggagtggatcgagcgacttacgaagtcggacacaaactaactgtcgacccagactaaccgtcacgggtacaggctaccaactagcgaaccacaacgactaacaccgtaccgaacgtacgaccgaacccggtacctaacgagtaccgtaaccgaggacggtaacgtccgtagaacgtacgttaccggacgtaaccgacccgtacgggtacttaggttacttacggnggtacgacggtaaggtacggtaaggttaaacgggttaaacttttacggttacggtaccgttccgtttacttaacgttcggtaaccggttacgggtaccgggtaaccgtaacccggtaccgtcggg

SEQ ID NO: 392453 - DNA, 683 bp, Homo sapiens
  misc_feature: GZ8MTXP02I2ZXO.39.81.H04.1.454.CMB.2.raw
  modified_base (213)..(213): a, c, t, g, unknown or other
  modified_base (265)..(265): a, c, t, g, unknown or other
  modified_base (270)..(270): a, c, t, g, unknown or other
  modified_base (277)..(277): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctnagtgaggtctctgcaggtcttctgttactaccttacatatgtatctggtggncgacncggcccnggacgaggctgaggtggagtggagtggatcgagtcgtacttaacgtaagttcggtaccaaacgtaaactaaactagtagaccccaacgtaaccgaacctccggaagggaccgtaagacgtaccaaacacgtaccgaaccaacgaacgaacaaccgacctaccgaacgacgaccgaccgtacacgtagtcggacgtaggacgacgtcgtagacgtagtacggtaggacccgacgtaccggtacgttagttaacgttcgttggaacgacggtaaggtacggtaaggggttaaaccgggttaaaagtttcgtttttacggaacccgttttaccgggttaccgtttaacgtttccggtaaacggttaccggggtaccgggggtaccggtaaccgggttaacccgtttcgg

SEQ ID NO: 392454 - DNA, 692 bp, Homo sapiens
  misc_feature: GZ8MTXP02HR5D7.39.81.H04.1.454.CMB.2.raw
  modified_base (231)..(231): a, c, t, g, unknown or other
  modified_base (269)..(269): a, c, t, g, unknown or other
  modified_base (570)..(570): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcaggtgaaggtctccngcaaggtcttctgttacctacctttaacactatggtancgtaggtggtgcgacgacggcccgtggaacgaggcttagagtggagtggagtggactcgaggtctacgttacaagtcggtacaaacgaaactaaactagtacgacccaaacgtaacgtaacccgtacggaagggaccaaggtacgtaaccaccctaagacccgaaaccacgaaaacgaccacactaacccgacggaacgacccgtaaccggaccctaacgacgtaccggaccgaagggacgaacggtccgtaaggacgtaacttccgacggaaccgtacgaccggtcgttagttacgtcgnggtacgaggtagagggtagtaaacgggtaaatttccggtttaggactttaccccggtactttaacggtttacgaaccggtttacggggacgggaccgttaaaccgggtacccgtttaaccgg

SEQ ID NO: 392455 - DNA, 547 bp, Homo sapiens
  misc_feature: GZ8MTXP02F0AEE.39.81.H04.1.454.CMB.2.raw
  modified_base (319)..(319): a, c, t, g, unknown or other
  modified_base (364)..(364): a, c, t, g, unknown or other
  modified_base (378)..(378): a, c, t, g, unknown or other
  modified_base (380)..(380): a, c, t, g, unknown or other
  modified_base (386)..(386): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggctgagtggatggatgatcagcgnttacaatggtcacacaaactatgacacagaaacctccagggcagngcacatcgaccaananacacanccagagcacgtaccacagtacgactagagagctagagatcgagaccgacgacggtcgtagtacttagtgtcgacgagaggaaggtacgggtaaatttacgtttacgacgtcggttaacccttcgtttacgacgtacgtcgggaccggtacggtaaccgtcg

SEQ ID NO: 392456 - DNA, 671 bp, Homo sapiens
  misc_feature: GZ8MTXP02FZKF2.39.81.H04.1.454.CMB.2.raw
  modified_base (400)..(400): a, c, t, g, unknown or other
tcagtcgcactagtcacgaccggtgctcgatttagtagtgtagattcgcgggccccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcagcttctggttacacctttacatatggtatctaggttggtgcgacgacggcccctaggacgaagggcttaggagtggagtgggagtggatcgagcgtacttacgaagtcggtacaacaacaaatagtacgaccacgacgaacctcgaggacagacgtcacagtacgaccanacgacacactccacgacgacgaccgactacgacgtacggaccgaggacggacgtaccgaggaacgtaagtccgtacgggaaccgacccggtaccgggtaccgttacgtttaacgttaacgttggtacgggacggtaaaggtacgggtaaacgggttaaacggggttaaacgtttagtttttacgggtaaccgtttacggttacccgtttaacgtttacggtaccggttacgggtaccggggtacccgtaacgggggtacccgtttaccggg

SEQ ID NO: 392457 - DNA, 720 bp, Homo sapiens
  misc_feature: GZ8MTXP02F2OBB.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacctacctttaccaacttatggtatcgtaggttgggtgcgacgacggcccctggacaagggtcttaggagtggagtgggatggatcgagcgtacttaacgaaagttcggacctaacgaaacctaaaaccttagtaccggacctaaccgaaccggaaaccctaccggaggggaccaagggaccgtaccaaccgtaagtaccgaacccaacgaacgaaccaaccgtaactacccgaacgaacgaccgtaacccggtaccctaacgtacgtacgggaccctaggacggaacgtccgtaagacgtatcggacggaaccgaccgacggggtccttagtaacttcgtgtacggacgaggtaacggtacggttaacggggttaaaatttacgtttacggtaaccgttccgtttaacccgttaagtttaccggtaacgttaccgggtacgggggacctaaccgggggtaaccctttccgggg

SEQ ID NO: 392458 - DNA, 744 bp, Homo sapiens
  misc_feature: GZ8MTXP02FPC16.39.81.H04.1.454.CMB.2.raw
  modified_base (271)..(271): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctctgcaaggtcttctgttacacctttacactatgtatcgtaggttggngcgacgacggccctggaacgaaggtctagagtggagtgggagtggatcgaggtcgtacttaacgaagttcggtaactaaccgaaactaaaactagtagaccccaaacgtaaccgaacccgtaccgaacggggacaacggacgtacccaaccgtagtaaccgaacccaaacaacgaaccaaaccaactacccgaaacggaacgacccggaaaccgtacccgtaacgaacggtaccgggaacccgttaagggacggtaacgccgtaaaggacgtagtaaccgtacggaaaccgtaaccgtacggaccggtttagttaaacgtttcgtgaacggacggtaagtaacggtaagggttaaaccggggttaaaattttaaccgtttacggaaccggtttacccgttaacctttaacggtttacgtaaaccgttaccggggtaccggggtaaaccgttaaccgggaacccggtttaccgg

SEQ ID NO: 392459 - DNA, 754 bp, Homo sapiens
  misc_feature: GZ8MTXP02GSCF2.39.81.H04.1.454.CMB.2.raw
  modified_base (465)..(465): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttctttggtggcagcaaacaacaggtcgcccactcccaggttcagctggtacagtctggagctggagatgaacgaagccgtggggcctacgaggtgaacggttcctccgtgacgtaaggtcctttacgttacggttaacctaccttttaaccaacttagtggttatcgtaggttgggtcgaccgacgacggtcccgtaggaacgtaggtcttggagtggagtcgggagtggatcgaggcgtacttaagagtcggtacaaacgtaaactaaatgtacgacccaacgaacgaaccgtcgaacggcaacgcgtacccactaacgaccaacccgaanaccgacaacaccgaccgaacgaccgaccgtaccgtaccgtaacgacggtacggaccgacgggaggaccgtacgtaaggtacgtacgtaccggaaccgggaacccgaccggtccggttacggttaagttacgttacggacggtacggaaacgtaagggtaacggttaaacggggttaaacgtttaacttttacggtttaccgttaaccgtttaccgtttaccgttaaggttaaccggtaacgggttaccggggaccggtaacccgggtaaccgggtttacccgtaccggg

SEQ ID NO: 392460 - DNA, 683 bp, Homo sapiens
  misc_feature: GZ8MTXP02GV9WT.39.81.H04.1.454.CMB.2.raw
  modified_base (277)..(277): a, c, t, g, unknown or other
  modified_base (406)..(406): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcgagttgggtncgacaggcccctggacaagggcttgagtggatgggatggatcagcgcttacaagtggtacacgaacaaactatgcccaacagaaaccctcgacgggtcagcgtccaccatcgaaccacgagaccaacgntacccgagacgacacccggacctacgagttacgggaaccctggaacggaacgcccgtaggacgtaagttccgtacgggaaaccgaaccgaaccggggtcccgttaggttaaaaccgtttccgtaggtacggaccggtaaacggaccgggtaaaggttaaccgggggtaaaatttgtttttacggaaccgtttacggggttaaccccctttgttttaacggtaaccgttaccgggtacgggggtacccgtaaacgggggttaacccccgtttccgggg

SEQ ID NO: 392461 - DNA, 710 bp, Homo sapiens
  misc_feature: GZ8MTXP02JCUS6.39.81.H04.1.454.CMB.2.raw
  modified_base (216)..(216): a, c, t, g, unknown or other
  modified_base (252)..(252): a, c, t, g, unknown or other
  modified_base (256)..(256): a, c, t, g, unknown or other
  modified_base (266)..(266): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtgggcctnagtgagtctctgcagcttcgtgttacaccttacatntgtntcgtagtggngcgacacggccctggacaggtctagagtggagtgggataggactcgacggtcgtacttaacgaagttcggtacaaacctaactaaactagtcgaccctaccaaccggaaccctaccggaggggtacctacgacgtccgaaccctagtaccgaaccaactacgaaaccacactaccgaacgacgtcaaacccggtaccaacgtagttaccggaacgtacggaaggtaccgaccgtaggaaaccgtcgtaaccgtacgggaaccgaaccggtccgggtaccgttagttaacgttaacgttgggtacgtacggaagggaacggttaccggggttaaaggttaaaacgtttcggtttacggtaaaccgtttccgggttaaaccctttcgtttacggtaaaccgttacggggtaccgggtaacccgtaacggggtaaccccgtttccgg

SEQ ID NO: 392462 - DNA, 686 bp, Homo sapiens
  misc_feature: GZ8MTXP02JD10Z.39.81.H04.1.454.CMB.2.raw
  modified_base (214)..(214): a, c, t, g, unknown or other
  modified_base (456)..(456): a, c, t, g, unknown or other
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctnagtgaaggtctcgtgcaaggcttctggttacctacctttaaccaactatggtaatcgtaggttgggtgcgacgtacggccccgtaggaaccgaagggtcttaggagtggagtgggatggatcgaggtcgtactttaacgaagttcggtacaaccgaacctaaaactactacgaccaacgaaccgtaacccgtcggaaaggggtccaggggtacctaccgaaacctacgtaccgaacccaaanaacgacaaaccacctacccgaaaccgaacccgacccggaccctaacgaccgttacggaaccgtacgggaacgtaccgacgttacgaagtacgtacgacgggaaccgaccggtaccgggtccgttaagttacgttagtgacgacggaacgtaggaggttacgggtaaatttcgttacgacgttcggttaccttgttacgacgttcggtacggaccgtaacgggtcctacgg

SEQ ID NO: 392463 - DNA, 731 bp, Homo sapiens
  misc_feature: GZ8MTXP02HPH1Z.39.81.H04.1.454.CMB.2.raw
  modified_base (277)..(277): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgacgccgtgggcctgagtgaaggttctcctgcagtcttctgttactacctttacaactagtggtatcgtaggttggngcgtacgacgccccgtaggaaccgaaggtcgttaggaggtggtagtaggggacgttgggaatcgagcgtacttaatagtacggtacaaacaacgtaaacctatacggacccacgaaccgaacccgtccggaaggacccaaggtccgtaccaactaacgccggaaaaccacgtaaacgaccaaaccgttaccgacgaaccgacgacccggtaacgcccttaacgacgtccgggaacgcggacgacgtccgttaacgaagtcgtacgtacgggtaaccgaaccggtacggtaccggttagttacggttaaccgtgggtacgacgggtaaagggtaacgttagggggtaaccgggtttaaatttacggttacgttaccgggtttaccgtttacccgtttaacgttaacggttacgtaccgggttaccgggaccggtaaccgggtttaccgtacccgg

SEQ ID NO: 392464 - DNA, 593 bp, Homo sapiens
  misc_feature: GZ8MTXP02H4HKZ.39.81.H04.1.454.CMB.2.raw
  modified_base (364)..(364): a, c, t, g, unknown or other
  modified_base (414)..(414): a, c, t, g, unknown or other
  modified_base (501)..(501): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcgtgactaaggcttctggttacctacctttacaacttatggtatcgagttggtgcgacgacggccccgtaggacgaagggtcttagaggtggagtgggatggatcgagtcgtacttacagtcgcaacgaaacctaaatntagaccaacgacgtacccgtcgaaggccaagcgtaccacagacgacctanaacgacacactccaacgacgcgaccgacacgacgtcggaactggacggctaccgtgagtatcgagacgacgacgcgttagattacgngtgacgagaggtagtacggtaaatttcgtttacgacgtttaccgtaccctttcgttagtaccgttcggtcgggaccggtacggtaccgtcgg

SEQ ID NO: 392465 - DNA, 598 bp, Homo sapiens
  misc_feature: GZ8MTXP02H7VNS.39.81.H04.1.454.CMB.2.raw
  modified_base (363)..(363): a, c, t, g, unknown or other
  modified_base (402)..(402): a, c, t, g, unknown or other
  modified_base (481)..(481): a, c, t, g, unknown or other
  modified_base (486)..(486): a, c, t, g, unknown or other
  modified_base (512)..(512): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgacaaggcttctggttactacctttaaccaactatggtatcaggttgggtgcgacgacggccccctggaacgaagggcttggagtggatgggatgggatcgaagcgattaacgatggtacacaaacaaaacctncgacctaacgaagaaccctcgaagggcaggatcaactancgaaccaacgagacccaaacacgtacccaacggaactcccgaacggaccctacgagtacggaacctggaagcgcctagngtacnctggacacgacgcgtacgtataccgngtacgacgagacgagacggggtaaattcgtttacgagtaccgtacctgtttacgacgttacggcgggaccacgggtaacccctcgg

SEQ ID NO: 392466 - DNA, 797 bp, Homo sapiens
  misc_feature: GZ8MTXP02FL5EZ.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgagccgtgggcctgagtgaggtctcctgacaaggtcttcgtaggttaacctacctttaccaacttagtggtactacgtaggttgggtgccgacgacggcccctagggaactaaggggtcttaggaggtggaggtgggtagtggactcgagtcgtacttaacaagtcggtacaacgaaactaactagtacgacctaaccgactaacccgtacggaggactaagaccgtaccaacgtagaccgaacccgaagtacaacccaaactaccgacccgaacgtacggacccgtaaccggtaccttaaaccgtggtaaccggtacgaaagggtaacgggacgtaccggtaaggtaacgtacgttaccggaaacgggtaacccgtaaccggtaccgggtaccgtttaacggttaaacgtttcggacgggtacggaaacggggtaacggtaaacggggttaaaacggggtttaaacgggtttaaaagtttacggttttaacccgggacggttttacccggtttacccgttaacggtttaacggtaaccggggttacccgggttaaccgggggacccggttaaaccggggtttacccgtcccgggg

SEQ ID NO: 392467 - DNA, 650 bp, Homo sapiens
  misc_feature: GZ8MTXP02HBHXA.39.81.H04.1.454.CMB.2.raw
  modified_base (485)..(485): a, c, t, g, unknown or other
  modified_base (539)..(539): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgagtctcctgcaggtcttctagttactaccttacatatggtatgtagtggtgacgacgacggtcctgtagacggtacggtgtaggtggtaggtaggtaggtagtagtacgagcgtactactacgtagtacgacaactaacgtaactacaccgtacgaccgaaccgtaccgacggacggacacggtaccacaacgtacgaccgaacacgaacaacctactacccgacagggacccacggaccctacagacgtacggacgagggtaacncgtacgagtaacgccgtacggaacgacccgacgtacccggttagttattaccgngtcgtacgacgtaaggtacgttaacgggtaaacgttaatttaccggtagtacccgtttacgttccgtttacgtacggtacggttacggacccggaacgttaacccgtccgg

SEQ ID NO: 392468 - DNA, 742 bp, Homo sapiens
  misc_feature: GZ8MTXP02JHGR3.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgacgaaggtcttcgtaggttaacctaccctttaaccaacttagtaggtatacgtaggttgggtgcgacgacggcccctagggaacgaaggtcttaggaggtggagtgggagtggactcgaggtacgtactttaacgaaagttggtaccaaccaaacgtaaactacgtaccgaaccccaaccgaaaccgtaaccccctcggaaccgggacgaacggaccggttaccaaacccacgtaccgaacccaaaccgacgaaccaaccgaacacccgaacgaacgaccgaccggacctaccgaggtaccgtaccgagggacgacgtaccgtagacgtacgtcgtacggaacccgacggtacccggtcggttaacgttacgttacggtacgtacggacgtaacggtaaggtacggttaaacggggtaaatttacgttacggtaaccgttaccggtttaccttaacggttaactaaccgggtacgggttacccgggaccgtaaccgggtaacccgttaccgg

SEQ ID NO: 392469 - DNA, 590 bp, Homo sapiens
  misc_feature: GZ8MTXP02JIWUA.39.81.H04.1.454.CMB.2.raw
  modified_base (512)..(512): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacgacggcccctggacgaagggccttaggaggtggagtggggattaggatcgagcggtacttaacaatggtacaacacaaatatcgaccacaagacctacgagggcagcgtccaacagtaccgacacagaccacactacccacgacgcacggccctacgacgtaggaccctggaacggacgtccgaggacgacgtccgtacgaaccgaccgacggtccgttagtacttcgtagngtacggagtagaggtacgggtaattagtttcgactcgtaccttgttacgacgttacggcggaccgtacggtacctcgg

SEQ ID NO: 392470 - DNA, 712 bp, Homo sapiens
  misc_feature: GZ8MTXP02HOOE0.39.81.H04.1.454.CMB.2.raw
tcagtcgcactagtcacgaccggtgctcgatttagtagtgtagattcgcgggtgatcaggactcctcagttcaccttctcacaatgaggctccctgctcagctcctggggctgctaatgctctgggtcccaggatccagtggggatgttgtgatgactcagtctccagtcctccctgccccgtcacccttggacaggcccgcctccatctcctgctaggtctagtacaaagcctcgtatactatgataggaaccacttactagaattgtcagcagacgcagacctaatctacgaagtcctacttaatttagttaacggttctaacccgggtactcggtcgggtacccagacgagtaccttcgacggccggtacgtagggttcgggtacgaggggtacctaacgtaagtaaaccgtttccaaaccgaaaaccgttaaggaaaaacgtacccgtaaagggaccggtaagggggtagggtaacggggtacggttagggaaggggtttaagggtttacggggttttacgggggtttaagtttacggttacgggacttaaggtacggaacgtaaacggaacctaaaccgtcgtaccggtccgttaccgtacttacggttcgggaccggtaacggggaccgtaaggtcgtaggtaacgacgtaaccggaaacctaaggtcggtacggtcgtaaccggactaccgtcttaacggttccg

SEQ ID NO: 392471 - DNA, 803 bp, Homo sapiens
  misc_feature: GZ8MTXP02IUAJH.39.81.H04.1.454.CMB.2.raw
  modified_base (189)..(189): a, c, t, g, unknown or other
  modified_base (215)..(215): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctnagtgaggtctctgcaaggtcttcgtgttactaccctttacaacttgtggtatcgtaggttgggtgcgacgacggccccgtggacgaaggtcttggagtggagtggagtggatcgaagtcacgttaacgaagtcggtacaacgtaaacgtaaactactcggaaccccaacgaacgtaaccccgtaccggaaggggaccgtaacgtaccggtaccaaaccgtaacgtaccggaaaccccgacgtaaaaccggaaccctaaaccaacccgtaccccgaaacgaccgtacccggaaacccggtacccctaaacggtaccgttaccgggaacccgttaggggaacggtacgggtaccccgttaggggaaacctacggtaaccgtagggaaaaccccggaccgttaaacccgggtcccgtttaagtaacgtttcggacgggttaccggaaggtaggtaaccgggtaaagggttaccgggttaaaagtttcggttttaccggaaccgtttacccgggttaaccctttccggtttacggtaaaccggtccggggttaaccgggtacccggtaaccggggttaaccccgttcccggg

SEQ ID NO: 392472 - DNA, 773 bp, Homo sapiens
  misc_feature: GZ8MTXP02GU7FG.39.81.H04.1.454.CMB.2.raw
  modified_base (158)..(158): a, c, t, g, unknown or other
  modified_base (297)..(297): a, c, t, g, unknown or other
  modified_base (326)..(326): a, c, t, g, unknown or other
  modified_base (335)..(335): a, c, t, g, unknown or other
  modified_base (499)..(499): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcncccactcccaggttcagctggtacagtctggagctgagatgacgagccgtcgggctgagtggacgtctccgtgacgtacggtctttcgttacggttacctacccttttaaccaacttagtagtatcgtaggttgggacncggaccgcggcccctagggaacgacggtnttagggagnggtagtgggtatggaatcgaggcttacgtaacagttggaacccaacgtaaacgtaaactcacgaaccccgtaaaccgaacggtaaacccccgttcgggaacgggtacctaaaacgggcctaacccgaacctaacggaacccgaaccgaccgaaactaaccctanaaaccctacccggaccgtaacggacccgttaacccggaccgtaacgaccggtacgggttaaaccggcgaaacggtaccgggtacgttaggaaaccggtttaacgtaccggaacgggtaacccgacggggtacccggttgtttaaacgtaccgtttcaagggggagttacggaagggtacgtaaggggttaacggttaatttcgttaccgtacgttaccttacgtttgttacccgaggtacccggggacggttaccggaccgttacctttacggg

SEQ ID NO: 392473 - DNA, 702 bp, Homo sapiens
  misc_feature: GZ8MTXP02IRICK.39.81.H04.1.454.CMB.2.raw
  modified_base (431)..(431): a, c, t, g, unknown or other
tcagtcgcactagtcacgaccggtgctcgatttagtagtgtagattcgcggggcacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctgagtgaaggtcctccgtgacaaggtcttcgtagttaccctacctttaaccaacttattggtatcgtaggtttgggtgaccgaacgaccggccccgtaggaaccgagggtcttaggaggtggagtggggatggagtcgagcgtacttaacgagttgacaacactaaactataaccacgacgaaccctcgaggcagacgtccacgatccgacccaanaacgtacaacgactacccgacgacgccgaacccgtactacgtaggtaaccgaccgtagggaccgacgtacgtacggaacgttagtccgtaacggaacccggtacccggtaccgggttacccgggttattaaacgggtttcgtacgggtacggacggtaaaacgtaggggtaaacggttaaagggggttaaactttaggtttaccgaccgtttaacgtttcccttggttacgtacgttaccggtcggggacccgtaacgggtaccttaccgg

SEQ ID NO: 392474 - DNA, 747 bp, Homo sapiens
  misc_feature: GZ8MTXP02IFSGG.39.81.H04.1.454.CMB.2.raw
  modified_base (284)..(284): a, c, t, g, unknown or other
  modified_base (338)..(338): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatagacgaagccgtggggcctcagtgaaggtctcctgacaaggtcttcgtgttacctaccttaacaactagtagtatcgtaggttgggtncgacgcgcccgtggacgaggtctgaggtggagtggatggatcgagcgtactaanagtcggtacaacaaacctaaactagtagacccaactaaccgacccgtacggacggacagaccgtaccacctagtaccgaaccacgaactaaccgaactacacccggaacgacgtacccgaaacccggtacctaaacgtacggtaaccggtacccgtaggaacggtaccggtaccgtaggaccgtagtacgtcgggaaacccgtaggtaacccgggtacgtttacggttaacgtttacggttcggacggtaaccgggtaagggtaacgggttaacgggtaaaacgggttttaaactttacgggttttacgtacccggtttaacgtttaccccgttaaggggttttccgtaaaaccggttccggggtaacggggtaccccggtaaaccggggtttaacccgttccccgggg

SEQ ID NO: 392475 - DNA, 650 bp, Homo sapiens
  misc_feature: GZ8MTXP02G2X6P.39.81.H04.1.454.CMB.2.raw
  modified_base (273)..(273): a, c, t, g, unknown or other
  modified_base (454)..(454): a, c, t, g, unknown or other
  modified_base (476)..(476): a, c, t, g, unknown or other
  modified_base (514)..(514): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttcgtgttacacctttacactatggtatcagttgggtncgacacggccctaggacgaaggggtcttaggaggtggagttgggagtggaagtcgtacgccgttacttacgaagttcggtacaacaaactaaactatacgaccctaacacgaaaccctccgaggggacagacgtccaaacgatacgaccagaacacactacaccgagacgctacgactacntacggctgacgtacgcctgtanattcgacgaacgacgtaccggtacgtacgttattacgnggtacgacggaaagacggtaaaggttacggggtaaatttaacggttttacggacgtttaccgggttaccctttaacggtttaacgtaccgttacgggtaccggggtaacccgtaccggggtaaccctttaccgggg

SEQ ID NO: 392476 - DNA, 706 bp, Homo sapiens
  misc_feature: GZ8MTXP02I1340.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggtcttctggttacacctttaccaactatggtatcagttgggtgcgacacggcccctggacaagggcttggagtggagtgggagtggatcgaggtcgtacttaacgaagttcggtaccaacgaactaaacgtatcgacccaaccgaacgtaaccctccggaacgggccaacgacgtccaaaccgtaacgtaccgaacccaacgaacgaaccaacctactacccaacggacgaccaaccgggacccttacgacgttacggaacccgtagacggacgaccgttacggagtacgttcgtacggaaacccgaaccgaccgggtcgttagttaaacgttcgtacggtaggaccggtaaggtaacggtaagggtaacggggttaaaatttacggttttacggaaccgtttaccgggttaccttcgttttaacggaccgtttacgggaccggggtaccgtaaccgggtaaccccgtttcggg

SEQ ID NO: 392477 - DNA, 695 bp, Homo sapiens
  misc_feature: GZ8MTXP02FMTI8.39.81.H04.1.454.CMB.2.raw
  modified_base (259)..(259): a, c, t, g, unknown or other
  modified_base (275)..(275): a, c, t, g, unknown or other
  modified_base (280)..(280): a, c, t, g, unknown or other
  modified_base (356)..(356): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctgttacacctttacaactntgtatcgtagttggtncgacncggccctggacgaaggtcttggagtggagtggagtggatcgagcgtacttaacaagtcggtacaacaacaaaactntagacccaacacgaaccctacgacggggacaagtcgtaccaactaagtaccgaaccaacaagaccaacactacccaggacaccgtaccgacctagacgtacggaccgtaggacggaaacgtccgtaggaacgtacgttaccgtacggaaccgaacccgtaccgggtacgtttaacggtaaatttccgaggttacggaaccgaacgggtaagtaacgggtttaaaccggggtaaaactttttagttacggttaaaaccgttccggtttaacccgttaacgtttaacggtaaccgtttacgggaccggggtaacccgtaacgggggttaaccccttccggg

SEQ ID NO: 392478 - DNA, 806 bp, Homo sapiens
  misc_feature: GZ8MTXP02H86ND.39.81.H04.1.454.CMB.2.raw
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcgaaggtctcgtgttactacctttacaactataggtatcagttggtncgacacggccccgtggacgaagggtcttggagtaggagtggggagtggactcgaaggtcgtacctttaacgaagttcgggtaccaaacctaaacgtaaaactactcggacccgtaaaccgaaccgtaaacccccgttaccgggaacgggtaccgtaacgggtacggtacccgtaaacccaacgttaacccgggaaacccaaaccggaaaccggaacccgaaacctaaccgttacccgaaacccggaacggacccgaacccgggtacccaccgaacgttaccgggtacccgtaggtaaccggggtacgtacccgttaaggaacggtacgttacgtaccggaaccggacgaccggaccgtaggttaacgttaacgttacggttcggacggtacgaagggtaacggtacgggtttaaaaccgggggaaactttttagttacggtaaaccggtttacccggttaaccgtttacgtttaaccggttaaccgtaccggggtaccggggtaaccggtaacccgggggttaacccccg

SEQ ID NO: 392479 - DNA, 745 bp, Homo sapiens
  misc_feature: GZ8MTXP02GOWNU.39.81.H04.1.454.CMB.2.raw
  modified_base (321)..(321): a, c, t, g, unknown or other
  modified_base (382)..(382): a, c, t, g, unknown or other
  modified_base (601)..(601): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcgaaggtcttctggttacctacctttaccaacttatggtatcgtaggttggtgcgacgacggccccgtaggacgaggcttaggaggtaggngtagggagttggaactcgaggccgtacttaagaagttggtaccaaacgtaaacctaaaatntacgaacccgtaaccgaaacgtaaacccgtcggaacggggacaacgtacggtaccaaccgaagtaccgaacccaactacgaacctaaactcgaacccgaacgaccgtaccgaacccggtaccctacggtaacgtacgggtaccgtacggaaggaccgtccgtacggatacgtacggtacggaacgaacccgtcgggtcgttacggtaactttaaccggngggtacgacggaacggtagggtaaacggttaaacggttaaagtttacggtttaccggtaaccgtttaccggtttaccctttaacggtttacggtaccggtttaaccggggcccgggtaaacccggtaccgggttacccggtacg

SEQ ID NO: 392480 - DNA, 626 bp, Homo sapiens
  misc_feature: GZ8MTXP02FNHGC.39.81.H04.1.454.CMB.2.raw
  modified_base (258)..(258): a, c, t, g, unknown or other
  modified_base (276)..(276): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtctcctgcaaggtcttctgttactaccttacaactntggtatcgtaggttgggncgacacggccctggacaagggtctggagtggagtggatggactcgagcgtacttaacaagtcggtaccaacgtaactaaactatcgaccaacgacgaaccctcgaggcaagtcgcacatacgaccacagacacataccgacgacgacgtacgacctacgagtacggaccgtaggacggacgtccgtaggagtactcgtacggaccgaccggacggtccgttgttaacgttaccgtgacggtagaggtaagtacggtaaacgggttaaatttcgtttacggtaccgttacggttacccttcgttttacgacgttaccgggtacggaccggtaacgggtacccgttaccggg

SEQ ID NO: 392481 - DNA, 695 bp, Homo sapiens
  misc_feature: GZ8MTXP02I9LQ7.39.81.H04.1.454.CMB.2.raw
  modified_base (215)..(215): a, c, t, g, unknown or other
  modified_base (269)..(269): a, c, t, g, unknown or other
  modified_base (406)..(406): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagcctggggcctnagtgaaggtctcctgcaaggcttctgttacacctttacatatgtatcgagtggncgacgacggccctggacaaggtctgagtggatgggatggatcgagccgtactttaacgaagttcggtacaacgtaaactaaaactgtcgaccaacacgtaaccctcgaaggtcagcgtccaaccgagtcgacccaanacgacacactacccgacgagaccacgacctacacgtcggacctaggaggacgtactaggacgtacgtaccgacggtaaccgacccggtaacggtcccgttagttaaacgttacggtacggttacggaccggtaaggtacggtaaacggttaaccgggggttaaaaatttcggttttaaccggtaacccgtttaaccggtttaaccccgtttaacggtttacccggtaaaccgtttaacccggggtaccggggtaacccggtaaccgggggttaacccgtttaacccggg

SEQ ID NO: 392482 - DNA, 618 bp, Homo sapiens
  misc_feature: GZ8MTXP02GC7UG.39.81.H04.1.454.CMB.2.raw
  modified_base (213)..(213): a, c, t, g, unknown or other
  modified_base (248)..(248): a, c, t, g, unknown or other
  modified_base (261)..(261): a, c, t, g, unknown or other
  modified_base (267)..(267): a, c, t, g, unknown or other
  modified_base (478)..(478): a, c, t, g, unknown or other
  modified_base (525)..(525): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtgggctnagtgaggtctctgcagcttctgtactacttacatntgtatcagttggngcgacncggcccgtaggacgaggtctaggagtggagtggagtggatcgagcgtaccttagacgtggacacgaacaaactgtcgacccaacgacgaacctcgacgggacaggtacgtccaacgtacgaccgaaccaacgacgtaaaccactaaccgtacccgaacgaacgcccgaccgggtaccctaacgacgtaccggaaccgtaggacgggtaacnccgtagacgtagtcgacggaccgacgaccggtcgtacgtacttacgngtacgacgtaggagtacggtaggtaatttgttaccgtcgtaccgtttacgtcgtttagaccgttacgggaccgggtacgtacggaccgtttcg

SEQ ID NO: 392483 - DNA, 652 bp, Homo sapiens
  misc_feature: GZ8MTXP02JVM0K.39.81.H04.1.454.CMB.2.raw
  modified_base (422)..(422): a, c, t, g, unknown or other
  modified_base (447)..(447): a, c, t, g, unknown or other
  modified_base (501)..(501): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtcctctgcaaggtcttcgtgtacctacttaccaactagtggtatcgtaggttgggtcgcgacgtacggccccgtaggaccgaagggtcttaggaagttggagtgggagtggactacgagtctacttacgaagtcggtacacaaactaaagtctagaccctacacggtacccgtacgagggtacaacgacgtccaactacncgaaccagtacaacactacaccganaacggtccaacggtaccaagcgtacggccgtagacggaagtccgagacgttacncgtacgaaccgtacgtaccggtacttagtactcgtagacggaacggtagtagggtaacggttaacggttaatttacggttaccgtaccggttactaccgtttaacgtacggtaaccgtcggggaccgggtaccggtaccggttcccgtacg

SEQ ID NO: 392484 - DNA, 688 bp, Homo sapiens
  misc_feature: GZ8MTXP02F70W1.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcagttggtgcgacacggcccctggacaaggcttagagtggagtgggatggatcgagcgtcttaacgaatcgggtactaacgaaacaaactacgtaggacccaaccgaacgaaccctaccgaacggggactaacggcggttacccaaccgtaaacgtacgaaacccgtaacaacggacccaaaccgaaacctacccgaacgaacggccaaacccgggtacctaacgagtacggacctagggaggaaaccggtcctaaggaggtactacgtacggaacgaccgacgggccgttagtactttacgtcggtacgcggaacgtaagtggtaacggggtaaaagttacgtttacgtacgttaccggttaaccttcgtttcggaaccttacgggttcggggaaccggtaaccgggtacccgtttacggg

SEQ ID NO: 392485 - DNA, 644 bp, Homo sapiens
  misc_feature: GZ8MTXP02IW2LE.39.81.H04.1.454.CMB.2.raw
  modified_base (411)..(411): a, c, t, g, unknown or other
  modified_base (424)..(424): a, c, t, g, unknown or other
  modified_base (473)..(473): a, c, t, g, unknown or other
  modified_base (484)..(484): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtgggcctcgagtgaaggtctcctgacaaggcttcgtaggttacctacctttaaccaacttagtggttatcgaggttgggtcgtcgacgtacggcccctggaacaagggcttggagtggagtgggagtggatcgaggcgacttaacaagtcggtacacaactaaactatcgaccacaacgacctacgagcgagagtaccacctanccgacctacgaanacacacgtaccaacgacgtacaccgactacgagtcggaactgaggaacnccgtagaactntaccgtggaaaccgtacgaccggttacgtaggttaactaccgtagtagaccgtaaggagtaaggtaccgggttaaaattacgttacgtaacgtccgtttaaaccgtcggttacgtaacgtttaccgggcgggtaccctaaccgggggtaacccttccggg

SEQ ID NO: 392486 - DNA, 650 bp, Homo sapiens
  misc_feature: GZ8MTXP02IKL51.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtgcccactcccaggttcagctggtacagtctggagctgagatgaacgaagccgtggggcctcagtgaaggtctcctgcaaggcttctaggttaacctaacctttaacaaactatggtatcgagttgggtgcgacacggcccctaggacaagggtcttgagtggatgggataggatcgaagcgacttaacaaagttcggtacaaacaaactaaaactagtgaaccccaaacaacgtaaacccctcgaaggggacagggactaccaaaccgatacgaacccagaaacgacaacagacccaagacgaccgaaccggtacctaacatacggaacctagaacggacacgtagagtaatctacgacgaacgaccggtacgttagtaacttactggtacgagaagaaagtacggtaaacgggtaaaattattttacgaccgtttacgttaacccttaagttcaaccgttacggacgggtaccgaacggggtaccctacgggg

SEQ ID NO: 392487 - DNA, 818 bp, Homo sapiens
  misc_feature: GZ8MTXP02G97VF.39.81.H04.1.454.CMB.2.raw
  modified_base (216)..(216): a, c, t, g, unknown or other
  modified_base (603)..(603): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactccctaggttcagctggtacagtctggagctgagatgacgaagccgtgggcctnagtgaacggtctcctgacaaggtcttcgttacggttaacctacctttaaccaacttagttggtaacttcgtaggtttgggtcgaccgtacgacggtccccgtagggtaaccgaagggtccttaggagtggagttgggacttagggatacgagtaccgttcgtaaactacggtcggtacaaacgtaaacctaaactacgtcgacccctaacgaacccgtaacccgtaccgggaaggaccgtaacgggtacccgttaaccaaacccgtagtaaaccgggaaccccaaaacggaaacgtacccaaaccgttacaaacccccggaaacgaccgggaacccgttaacccgggacccttaacgacggttaccggaaccgttaggaccggtacnccggtaaggacgtactacggacggaaaccgtaccggacgggtacttaagtacgtttaccgtagggagtaccgggtaaaggtacggttaggggtaaaggggtttaaaacttttcgggtttaccgtaccggttaaccgtttaccccgtgggtttttaaacccgaccgggtttaccgggtaacccgggtaccggttaaccggggtacccctttaccgg

SEQ ID NO: 392488 - DNA, 848 bp, Homo sapiens
  misc_feature: GZ8MTXP02FMPUI.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaaggtcttctggttaacctacctttaaccaacttagtggtatcgaggttgggtgaccgacgacggtcccccgtagggaacaacggggtcgtttaggaggttgggagtggggtaagtgggacttcgaaggcgtactttaacgaaagttcgggtacaaaccaaaccaaaactacgtacgacccaaccgtaaccggaaacccctccggaaggggaccaagggtaccgtaccaaccgactaccgaacccaacgaaccgaaaccaaacaacttaccccgaaacggaacgacccgaacccgggtaccctaacgaacgttacgggaacccgttagggaacgggtacgtacccgtaaggacgtaacgttcccgtaacggtaaccccggaacccggtaaccggggtacccgtttaacggtttaaccttaccggttacggttaccgggaacgggtaaacggtaaaacgggttaaacgggttaaacccgggggttaaaaattttacgtttttaaccgggaaacccgtttaacccgggtttaacccccttaacggtttaacccggtaaccggttaacccgggttccgggggaaccccgttaaaccgggggtaaccccgtttaacccgggg

SEQ ID NO: 392489 - DNA, 665 bp, Homo sapiens
  misc_feature: GZ8MTXP02IFTTN.39.81.H04.1.454.CMB.2.raw
  modified_base (405)..(405): a, c, t, g, unknown or other
tcagtcgcactagtcacgaccggtgctcgatttagtagtgtagattcgcggggacccaaaaaccacacccctccttgggagaatccccctagatcacagctcctcaccatggactggacctggagcatcccttttcttggtggcagcaacaacaggtgcccactcccaggttcagctggtacagtctggagctgagatgacgaagccgtggggcctcagtgaaggtctcctgcaaggcttctggttacacctttaccaactataggtatcagttgggtgcgacaggcccctggacaaggcttgagtggatgggatggatcgagcgtacttacaatggtcaacaaccaaactatgaccctaacgacgaaccctccgagggccagagtccaacctagacgaacccanagaacaccaatcccaacgacgaccaccgaccctaacgatcgggaccctaggaaggacgcccttggaacgtacgtccgtaaggacccgaaccggtaaccggcccggttagttacgtttaacctgggtgaccgaaagggtagacggtaaaccgggggtaaaattacggtttttacgaaccgtttccgggttaacccctttcgttttaccggaacgtttaccggtcgggggtacccgtaacgggggtaaaccccctttcgggg

SEQ ID NO: 392490 - DNA, 740 bp, Homo sapiens
  misc_feature: GZ8MTXP02F697L.39.81.H04.1.454.CMB.2.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctccgtgacaggtcttcgtggttactacctttaccaactagtggtatcgtaggttgggtgcgacgacggtccccgtggacgaaggtcttaggagtggagtgggatggatcgagctcttacagtggtacaacaaactaaatatacaccgaacaacgaccctaccggaggtaccaaggtacgtacccaacgtacgtaccgaacccaacaaacggaacccaaacgaaccttacccgaacgacgacccgaaccggtaccctacgaacgttcggacccgttaaggacgaccgtacccgttaggaaacgtacgtaccgtaacggggaaccgaaaacccccgtccgggggtacccgtttaacgttaaacgttttacccgtagggttacggtaaccgggaaggtaaaccggtaaggggtttaaaccggggttaaaattttacggtttacggtaaccggttccggttacctttaacgttacgtaacgtaccgggtcgggaaccgtaacgggtaccctttaccgggg

SEQ ID NO: 392491 - DNA, 734 bp, Homo sapiens
  misc_feature: GZ8MTXP02I5YXW.39.81.H04.1.454.CMB.2.raw
tcagtcgcactagtcacgaccggtgctcgatttagtagtgtagattcgcggggacccaaaaaccacacccctccttgggagaatcccctagatcacagctcctaaccatggactggacctggagcatccttttcttggtggcagcaacaacaggtgcccactcccaggttcagctggtacagtctggagctgagatgacgaagccgtggggcctcaggtgaaggtctcctgacaagtcttcgtggttacctaccttaccaacttattggtatcgtaggttgggtgcgtacgacggccccgtaggacgaagggtcttggaggtggagtgggatggatacgagtcgtacttacgaagtcggtacaaccgaaactaaacgtactacgacaacccgtaccaacccgtaccgacggggacctaagaccgtacgacctacgtaaccggaacccaacgaacgaccaaactactacccgaacgaccgacacccggtacaacacggtcgaaacggtcgggaacgtcgaccgtaaggtacacgttacggtaccgaacggaacccgtacgggtaccgtttagttaacgttaccggtgggtacgacgtaaaggacggttaacggggttaaagggtttaaaagtttcgtttaacggtaccgttaccgggttaaccctttcgggttaacgttaaccgggtacggtaccgggggtacccgtaaccgggggtacccttacgggtcccccg

SEQ ID NO: 392492 - DNA, 661 bp, Homo sapiens
  misc_feature: GZ8MTXP02I2KAZ.39.81.H04.1.454.CMB.2.raw
  modified_base (215)..(215): a, c, t, g, unknown or other
  modified_base (388)..(388): a, c, t, g, unknown or other
  modified_base (423)..(423): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctnaggtgaaggtctcctgcaaggcttctggttacaccttaccaatatggtatcgaggttgggtgcgacacggccccgtggacgaaggtcttggagtggagtgggatggatcgagcgtacttagaagtggtacaacaaacgtaaactagtcgacccaacacgaacctcgaggcagngtcaacatacaccacagaacacatacccgacgacncgaacggaccctaacgattacgggaccctagggaacgtacggacccgtagaaacgtactccggtacgaaccgtaaccgaccggtaccgttggttaaactttacggtacgtaggacggtaaaggtacggtaaacggttaacggggttaaaattacggtttttacgaaccgtttcggttaaaccttggtttaacgtaaccgttacggtaccggggtcgtaacccggggttaaccgttcgg

SEQ ID NO: 392493 - DNA, 738 bp, Homo sapiens
  misc_feature: GZ8MTXP02GR37F.39.81.H04.1.454.CMB.2.raw
  modified_base (229)..(229): a, c, t, g, unknown or other
  modified_base (235)..(235): a, c, t, g, unknown or other
  modified_base (290)..(290): a, c, t, g, unknown or other
  modified_base (339)..(339): a, c, t, g, unknown or other
  modified_base (470)..(470): a, c, t, g, unknown or other
  modified_base (591)..(591): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaaacaacaggtcgcccactcccaggttcagctggtacagtctgtagctagagatggacgagccgtgggcctagagtgagttccnccgtanacgaggtcttctagttacctaccttaacacttagttggtatcgtaggttcgggtnaccgtacgaccggtccccgtaggaacgtaggttcgtaggaaggtacggngtgggacgtggacgtcgaacggtcgttctaaacgtaggtacgtaacactaaaacgtaacttacgcgaaccctaacgaaccgtaacgtaccggagaacgacgtcggtaaccaactagacaaaccgacgtaanaacccagtaccaccggagacctaccgaaccggtacaacggtcgtacgggtaccgaggcgtaaagcctaaacgagtactacggtacgaccgaacggtacgtacggttataaactcggttacncggggtaaactacgggtaaaggtcccgggttaaagtaaagttttacccggttaacaccgggttttaccggttaaacctttcggtttaaaacggaccggttttcgggaaaccgggggtacccggttaacccggtaaccgtttccccgg

SEQ ID NO: 392494 - DNA, 678 bp, Homo sapiens
  misc_feature: GZ8MTXP02ILBLG.39.81.H04.1.454.CMB.2.raw
  modified_base (426)..(426): a, c, t, g, unknown or other
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctttacaacttatggtatctagttggtgcgacacggcccctaggaacgaagggcttagaggtggatgggagtggatcagcgtacttaacaagtggtaccaacgtaacaaaactatacggaccaaacaacggaaccctacgacggggacaagacgtacaaaccactacgaaccccaanaacgaaccacactacccaacgacgaccacccgactaacacgtacggaacctggaaacggacgtcccgtagagtacttacgtaggaaccgaccgtaacggtccggttaagttacgtttacgtggtacgacggaggaacgtacgggtaaacgggttaaaatttacgtttaacggtacgttacggtttaccccgttaagttttacggaacgtttacggacgggggttacccaaacgggggtttaacccgttccgg

SEQ ID NO: 392495 - DNA, 727 bp, Homo sapiens
  misc_feature: GZ8MTXP02I59G0.39.81.H04.1.454.CMB.2.raw
  modified_base (262)..(262): a, c, t, g, unknown or other
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttactaccttacactatgtatntagtgggtgcgacacggcccctggacgaagggcttgaggtggagtgggatggatcgaggtcgtacttaacgaagttcggtacaaaccaaacaaaacgtatacggacccaaccgaacgaaacccctaccggaagggaccaaggacgtccaaaccctaagtccgaaacccaacgaacgaaccaaactactaccccgaaggaacgaccggaacccggtacctaacgtacgtcgggaaacccgtagggaacgggactaccgtaagggaacgttactaccggtacggaaaccgtaccccggacgggtacccgttaggtttaacgtttaccgttgggcggtaacggaaaggtaacggtaagggttaaccggggttaaaaatttcgtttaacggtaccgttacggtttacccttgtttaacgaaccgtttacggggaccggggtaccggtaacggggtacccctttacgggg

SEQ ID NO: 392496 - DNA, 669 bp, Homo sapiens
  misc_feature: GZ8MTXP02IKMLU.39.81.H04.1.454.CMB.2.raw
  modified_base (419)..(419): a, c, t, g, unknown or other
tcagtcgcactagtcacgaccggtgctcgatttagtagtgtagattcgcgggggacccaaaaaccacacccctccttgggagaatcccctagatcacagctcctcaccatggactggaccctggagcatccttttcttggtggcagcaacaacaggtgcccatcccaggttcagctggtacagtctggagctgagatgacgaagcctggggcctcagtgaaggtctcctgcaagcttctggttacacctttacaactatggtatcagtgggtgcgacaggccctggacaagggcttagagtgatgggattggatcaggcgtccgttaactaaagtcgggttaccaacgtaaacctaaaactacgtagacccctaacaacgtaaccacccgtaaggggaccaaggacgtacgaaacctanacgtaaccaacgagaaaccactaatacccgaacgacgacaaccggacttaaccgacgtagacccgtaggaacggtaacgtccctagaacgtatacccgtagaaccgacgaacggtaccgtagtacttaacgtggtacgaccgtagacggtaaacggtaccgggaaaattacgttttacgaaccgttacggtaacccgttgtttaacgaccgttaacgtacggggtaccgaaccggggtaaacctcccggg

SEQ ID NO: 392497 - DNA, 629 bp, Homo sapiens
  misc_feature: GZ8MTXP01EIWX3.4.40.D07.1.454.CMB.2.raw
  modified_base (208)..(208): a, c, t, g, unknown or other
  modified_base (277)..(277): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccaccctgttctttgtctccgaaggggaaanagccatcctctcctgcagggccagtcagagtgttagcagctacgttaggctaggtaccaacagaaaccnggccaggcctacccaggctctcatctatgatgcatccaacacggcccactggacactcccagcccccgaggttcaggtggacgtaagggttcgggtcgtggggaactacggtactttccacttctacacccatcagcacgacccttaagacgtacctagaaagttacttttagacttaggttttaatttacgtggttaccagtacgagtcccgttaacgacccgtaacgttcggggtacccttccgttccgtaaccggttttccgggggacgggtaacggggttaaccgaagggttcgggaagttcgttaacgaaaacggtactggtacgggcttacggtcaacccgttaag

SEQ ID NO: 392498 - DNA, 533 bp, Homo sapiens
  misc_feature: GZ8MTXP01D4YRT.4.40.D07.1.454.CMB.2.raw
  modified_base (200)..(200): a, c, t, g, unknown or other
  modified_base (257)..(257): a, c, t, g, unknown or other
  modified_base (285)..(285): a, c, t, g, unknown or other
  modified_base (303)..(303): a, c, t, g, unknown or other
  modified_base (533)..(533): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccacctgtcttgctcaggggaangccatcctctcctgcagggccagtcagagtgtagcagctacttaggctggtaccaanagaacctggccaggcctccaggctcctnatctatgatgcatccaancggcccagtgccatcccagccccaggttcagtgctaaggtgggtctgggacagacttcgactctacacatcagcagcctagacgacctagaagtatttgacttaaggtttacttacgtgtaccagccgtagcgttacgcctacgtcggtcccttcgtcgtaacgtttcgggacgggtacggacgtaaggggtgaacgcttacgaaacgtatcggtaggcttgcaaccgtn

SEQ ID NO: 392499 - DNA, 650 bp, Homo sapiens
  misc_feature: GZ8MTXP01DRNT1.4.40.D07.1.454.CMB.2.raw
  modified_base (201)..(201): a, c, t, g, unknown or other
  modified_base (210)..(210): a, c, t, g, unknown or other
  modified_base (255)..(255): a, c, t, g, unknown or other
  modified_base (262)..(262): a, c, t, g, unknown or other
  modified_base (277)..(277): a, c, t, g, unknown or other
  modified_base (296)..(296): a, c, t, g, unknown or other
  modified_base (328)..(328): a, c, t, g, unknown or other
  modified_base (332)..(332): a, c, t, g, unknown or other
  modified_base (350)..(350): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccacctgtctttgctcgagggaangccatcctntcctgcaggccagtcagagtgtagcagctacttagctaggacaanagaaccngcagctccagctctnatctatgatgacatccaangcccatgcatccagcccagtcagtgcagtgcnggangacttcactctacactancacgcacgtacctaaggacgtaccgtaggaaacgttattttaccggtaactttaacggtttttaatttaaaccgggtttacgttaccgaacggtaccgtaacggtaccggttaacgtacccgtacggttaccggttacccttaccgttaccggtttaaccgggtttaccgggggaacggggtaaacggggttaaaccggtaaacggggtaacggggttaaacgttaacgttaaacccggtaaaaacggtacggttaacgggtaccgggtaccgttaccgtaacccgttaaaccgttaacg

SEQ ID NO: 392500 - DNA, 719 bp, Homo sapiens
  misc_feature: GZ8MTXP01B649C.4.40.D07.1.454.CMB.2.raw
  modified_base (205)..(205): a, c, t, g, unknown or other
  modified_base (277)..(277): a, c, t, g, unknown or other
  modified_base (302)..(302): a, c, t, g, unknown or other
tcagagcactgtagcacgaccggtgctcgatttagtgatagagcgtaacaacaggagggggaggaactgctcagttaggacccagagggaaccatggaagccccagctcagcttctcttcctcctgctactctggctcccagataccaccggagaaactgtgttgacacagtctccagccacctgtctttgctccgagggaaagngccatcctctcctgcacgggccagtcagagtgttagcagctacttaggctggtaaccaacgaacgaaaccgnggaccaggcctcccgaggcctcctnatctatgatgactatacccgaaacgacgggccccaacgtcggacctaaccgtcccgaacgtccccccgtagggtttcaacgggtcggaccgtaagggttcgggggtcgtacgggggaaactacggtacctttaccaacttctaccaccctataccacggcaacgtaccgtaacggacgtaccgttaaggtaaacgttaagttttacggtacgtttaaacggttttactttaacgtttacgttacgtaacggaccgtacggtaccgttaccgtaaccccgtcgtccgggttacccttccgttccggttaaccgggtttcgggggacccggggtaacggggaacccggtaaagggtagggacgttaacgttacggaaaacggtacgtggttacgggcttacggaaccgttaacttaacg

SEQ ID NO: 392501 - DNA, 696 bp, Homo sapiens
  misc_feature: GZ8MTXP01BP4II.4.40.D07.1.454.CMB.2.raw
  modified_base (206)..(206): a, c, t, g, unknown or other
  modified_base (446)..(446): a, c, t, g, unknown or other
  modified_base (667)..(667): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccaccctgtctttgtctccgaggggaaancgccatcctctcctgcgagggccagtcagagtgttagcagtctacgttaggctacggtaaccaagacggaaaccctggacccagggccctacccgaggtcccttcctactattcctaagttgaattcgacctaacgtaccccaaacgaccgggccccaacgtcggacctaacctccccgaggtcccccgtaagggtttcaagggttcgggactaaaggggttcgggtcgtaggggaaccngtacctttcaccgtctaccaaccctatccgacgtaccaacgtaccgtaaacggtacgtaccgttaaggtaaagtttacgtttaggaacctttaaggtttttaaacttcgttacggttaccaaggtacccgaaggtcccgtagtaccctacgtcgttccctcttacgtcggttcgggacgggtaacggaccgtaagggtcgagttacttacgaaaaccggtnttcggcgtacgttacggccttaaccgttg

SEQ ID NO: 392502 - DNA, 602 bp, Homo sapiens
  misc_feature: GZ8MTXP02HUKI3.4.40.D07.1.454.CMB.2.raw
  modified_base (205)..(205): a, c, t, g, unknown or other
  modified_base (264)..(264): a, c, t, g, unknown or other
  modified_base (294)..(294): a, c, t, g, unknown or other
  modified_base (313)..(313): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccaccctgtctttgtctccaggggaaanagccatcctctcctgcagggccagtcagagtgttagcagctacttaggctggtaccaanagaaacctggccaggcctcccaggctcctnatctatgatgcatccaacncggcccagtcggcactcccgagccccgaggttccaggtggctaggttgggtcgtggggacaggtaccttcacttcctacaccatccagcagccctaagagcctagaagtatttgacttaagtttattacgttgtacaggacagaccgtagccctacgttcggcccttcgtaccgtacgtttccggggacgggaaacgggtaaccgtaaacggggttgggaacgtaacggttaaccgaaaaacgggtaccttggggttacgggacctttacggacccgtaacccttaacg

SEQ ID NO: 392503 - DNA, 536 bp, Homo sapiens
  misc_feature: GZ8MTXP02GCNPS.4.40.D07.1.454.CMB.2.raw
  modified_base (206)..(206): a, c, t, g, unknown or other
  modified_base (265)..(265): a, c, t, g, unknown or other
  modified_base (314)..(314): a, c, t, g, unknown or other
  modified_base (442)..(442): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccaccctgtctttgtctccgaggggaaanagccatcctctcctgcagggccagtcagagtgttagcagctacttaggctggtaccaanagaacctggccaggctcccgaggctcctcatctatgatgcatccaaacnggccccatggcactcccagccccaggttcaggtgcaggtgggtctgggacagtaccttcactctacaccatcagcagcctagacgcctagaagtatttgacttagtttattactgtacagcagcgtanccactcgacctctactacgtttcggacgggtacgggaaccgtaagggtggaacgtagtaacgaaaacgacgtaggtacggcctaggaccactac

SEQ ID NO: 392504 - DNA, 595 bp, Homo sapiens
  misc_feature: GZ8MTXP02HWXXM.4.40.D07.1.454.CMB.2.raw
  modified_base (209)..(209): a, c, t, g, unknown or other
  modified_base (325)..(325): a, c, t, g, unknown or other
  modified_base (424)..(424): a, c, t, g, unknown or other
  modified_base (464)..(464): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagcccacccttgttctttgtctccgaggggaaangccatcctctcctgcagggccagtcagagtgttagcagcttacgttaggctggtaaccaacagaaaccgtggaccaggcctcccgaggcctcctcatctatgatgacatccgaacncgcccagtcggcactccagcccctaggttcaggtggctaggttgggtcgtgggactagtaccttcactctacacatcagcagcctagcgctagaagttntttgactttagtttacttactgtacagaccgtagcgtacnccctacgtcggtaccctcgttccttacggtttaccggggacgggtaaacgggaccgtaaaggggtcgggaaacgtacgttaaaccgaaaacggtacgttcgggtacggacctacggtaccaaacccgtttg

SEQ ID NO: 392505 - DNA, 552 bp, Homo sapiens
  misc_feature: GZ8MTXP02GIOXJ.4.40.D07.1.454.CMB.2.raw
  modified_base (206)..(206): a, c, t, g, unknown or other
tcagagcactgtagcacgaccggtgctcgatttagtgatagagcgtaacaacagagggggaggaactgctcagttaggacccagagggaaccatggaagccccagctcagcttctcttcctcctgctactctggctcccagataccaccggagaaactgtgttgacacagtctccagccaccctgtctttgctccgaggggaaagngccatcctctcctgcagggccagtcagagtgtagcagctacttaggctaggtaccaacagaaacctggccaggcctcccaggcctcctcatctatgatgacatccaacacggcccagtcgccactcccagccccgtaggttccaggtcggactagggtcgggtcgtggggacagtaccttcactctacaaccatcagcacgcctagacgcctaggaatatttgacttagtttattactgtcaggtcagcgtacgcctagtcggcctacgtctacgttcgggacggacggaccaaagggtcgaagtactaacgaaaacgtacgtggtacggactcgacctaccgtag

SEQ ID NO: 392506 - DNA, 573 bp, Homo sapiens
  misc_feature: GZ8MTXP01DFIBG.19.80.H03.1.454.CMB.2.raw
  modified_base (220)..(220): a, c, t, g, unknown or other
  modified_base (247)..(247): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtncccctgaacctgaaaggccaaatgagacccaagacaggccaagtggtgtgagacccctgaggagctgggccctggtcccaggcagcgctggcccctgctgctgcctgggtctggccagtcggtcgcccatcggcctgctgcgcccaatgtgcaccgcaaacgcggggacccagacccgtggacgccgtacgacggttggggaaacgcgaacgcccggaatcccgaacgcccgtggccggtagcccgtgggtcggggcagggttcgacgcccgaaacggccttcgccccgttcggtccactctcgtcccgccctcccttccgaaccg

SEQ ID NO: 392507 - DNA, 642 bp, Homo sapiens
  misc_feature: GZ8MTXP01D9EH0.19.80.H03.1.454.CMB.2.raw
  modified_base (219)..(219): a, c, t, g, unknown or other
  modified_base (244)..(244): a, c, t, g, unknown or other
  modified_base (371)..(371): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagagtnccctgaacctgaaggccaatgagacccaagacaggccaagtgggttgtgagacccctgaggagctgggccctggtccccaggcagcgctcggcccctgctgctgcctgggctgggcccagtcggtcncccgatcgggcctgctcgcgcccatggttgcgaccgcgaaacggccggggacccacggacccctgggaaccgccgtacgacggtttcgggggaaacggccgaacggcccgaagtccccgacgcccgtacggccggtagccccgtgggtcgggggcctagggttccgacggaccccgaaagggccccttccggcccccccgttaggggtcccctaacccttcccgttcccggtttccccccttaccccttccccgttaaccccgaaccccgg

SEQ ID NO: 392508 - DNA, 568 bp, Homo sapiens
  misc_feature: GZ8MTXP01EC0SG.19.80.H03.1.454.CMB.2.raw
  modified_base (219)..(219): a, c, t, g, unknown or other
  modified_base (459)..(459): a, c, t, g, unknown or other
  modified_base (468)..(468): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagagtgccctgaacctgaagccaaatgagacccaagacaggccaagtgggttgtgagacccctgaggagctgggccctggtcccaggcagcgctggcccctgcctgctgcctggggtctggcccatcgggtcgcccatcggccctgctgcgcccaatgtgcaccgcaaagcggggacccagacccctggacgcctcgacgttggggaacgcaagccgacnccgcgccgngcggtgcgtggtcgggcgcggcgacgccgaacggtccgttccggccccgttcggtcctaccgtccgttccgtccccttaccccttcccgttcccgtaacg

SEQ ID NO: 392509 - DNA, 599 bp, Homo sapiens
  misc_feature: GZ8MTXP01DN5UR.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctgggccctggtcccaggcagcgctggcccctgctgctgcctgggtctggccagtcgggtcgccccgatcgggccctgcctcgcgcccaatggttgcgaccgcgaaacggccggggaccccaacggaccccgtggacgcctcgacggttcggggaacgcgacgccgatcccagcctggccggagccgtggtcgggggcacgggttcgacggcccgaaacgggccttccggccccgttccgggtccaccgttccttccggttccccacccctccccgttcccgaaccgg

SEQ ID NO: 392510 - DNA, 627 bp, Homo sapiens
  misc_feature: GZ8MTXP01B8188.19.80.H03.1.454.CMB.2.raw
  modified_base (220)..(220): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagganccatgctgcaagtcggccagaggtcnccctgaacctgaacggccaaatgagacccaagacaggccaaaggtgggttgtagacgacccctggaggagcgtcgggcccctggtccccaggcagcgctcggcccctgcctgctgcccgttggggtctcggcccagtcgggtcccgcccgagttccgggcccttggccgtcggcccgacccctaagttcggttcgaccgaccggacgaaacgggacccggggaacccgacgacccgtaggacgcctcgacggttacggggaacgcgaacgcgactccgacgccgtacggccggtacgcccgttggcggggcgacggttcgacgccgaaggccttccgccccgttcgtcacctctcccgtccccgcctcccgttccgaaccg

SEQ ID NO: 392511 - DNA, 732 bp, Homo sapiens
  misc_feature: GZ8MTXP01DPS7T.19.80.H03.1.454.CMB.2.raw
  modified_base (220)..(220): a, c, t, g, unknown or other
  modified_base (247)..(247): a, c, t, g, unknown or other
  modified_base (296)..(296): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgaggganccatgctgcaagtcgggccagaggtcnccctgaacctgaaggccaaatgacacccaaagacaggccaaagtgggtntgacgacccctgaggagcgtcgggcctggtcccaggcagcgctcggcccctgctgctgccctgggtctggcccagtcgggtccgccccatcgggccctggcctcggccgaccccaaagttcggttcgaccgacccggaccgaaaacgggacccgggggaacccctaacgggaccccgtacgggacgacccgtacgtacggttcgggggaaacggccgaaacggccccggaaactccccgaacggtcccgtacgggccgggtaacggccccggttggggtcgggggtccgtaaacggggttcccggaaacgggcccccgaaaacggggtccccgttaccccgggcccccccgttaccggggttccccgtaaccccttcccgtttccccgggtttaccccccaaccccctttcccccgttaaccccgtaaaccccggg

SEQ ID NO: 392512 - DNA, 559 bp, Homo sapiens
  misc_feature: GZ8MTXP01AZ2P9.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgcccctgaacctgaagccaatgagacccaagacaggccaagtgggtgtgagacccctgaggagctggggccctggtcccaggcagcgctggcccctgctgctgcctgggtctgggccatgggtcgcccatcgggcctgctgcgcccaatgtgcaccgcaaagcggggacccagaccctggacgcctcgacgttggggaagcgagccgatcccagccctgcggacgtccgtggtggggcagggttccacggcccgaaaggccgttcgcccccttcggtccacctccgtcgttccccaccctcccttccgaaccgg

SEQ ID NO: 392513 - DNA, 642 bp, Homo sapiens
  misc_feature: GZ8MTXP01D5MT0.19.80.H03.1.454.CMB.2.raw
  modified_base (221)..(221): a, c, t, g, unknown or other
  modified_base (380)..(380): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcggccagaggtcgcccctgaacctgaaggccaaatgagacccaagacaggccaagtggttgtgacgacccctggagagcgtgggccctggtcccaggcagcgctcggcccctgctgctgccgtgggtctggcctagtcgggtccncccgagtcgggccctgcctcggccgtcccctaagtcggttcgccgacccggacgaaacggcccggggaacccacggtacccgcggacgccgtacgacggttcggggaaacgcgaacgcccgaactcccgacgccgtcggcggacggtcccgttgggcggggcacgggttccgacggcccgaaacgggtcccttccggcccccgttcgggtccctaccgttcccgttccgttcccccaccccttcccgttaacccgaacccgg

SEQ ID NO: 392514 - DNA, 635 bp, Homo sapiens
  misc_feature: GZ8MTXP01CF8CU.19.80.H03.1.454.CMB.2.raw
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagcgtgggccctggtccccaggcagcgctcggccctgctgctgcctgggtctggccagtcgggtccgcccgatcgggcccttggcctcggaccgccctaagtcggttacgcaccgacgaaacggccggggaccccgacggaccccgtcgggacgccgtacgacggttacggggaagcgacgcccgaactcccgacgcccgtggccggacgccggtcggtcgggggcacgggttccgacggcccgtaaacgggccttccggcccccgttccggtccctccgttccgttcccggttccccgttccccgttcccgttccccgtaacccggg

SEQ ID NO: 392515 - DNA, 654 bp, Homo sapiens
  misc_feature: GZ8MTXP01DVVAP.19.80.H03.1.454.CMB.2.raw
  modified_base (168)..(168): a, c, t, g, unknown or other
  modified_base (220)..(220): a, c, t, g, unknown or other
  modified_base (247)..(247): a, c, t, g, unknown or other
  modified_base (384)..(384): a, c, t, g, unknown or other
  modified_base (459)..(459): a, c, t, g, unknown or other
  modified_base (631)..(631): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaagtcggccaggagtcnccctgaacctgaacggccaaagtgacgaaccaagacaggaccaaggtgggttgagacgacccctggaggagcgtcgggccctggcccaggcagcgctcgcccctgctgctgccgtgggtctggcctagtcgggtccncccagtcgccctgctacgccgccctaagtcgtacgccgaaccgacgaaacgggcccgggaacccacggaccccgngggaccgcccgtacgacggttacggggaaacgccgaacggcccgaactcccgaacggtcccgtagggccggacgtcccggtggggcggggcgtacgggccgacggcccgaaacggtcccgttccccggttccccggttccggtaactcccgttcccgttcccgggtcccccnccccttcccgttaacgaaccggg

SEQ ID NO: 392516 - DNA, 653 bp, Homo sapiens
  misc_feature: GZ8MTXP01BOPYO.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaaggtcgggccagaggtcgccctgaacctgaaggccaatgagaccaagacaggcaagtggtgtgagaccctgaggagctgggccctggtcccaggcagcgctcggcccctgctgctgccgtgggtctggcctagtcgggtccgcccgagtcgggccctgccgtcgccgtccctagttcggtcgcgaccggcgaaacggcccggggaacccacggaccccgtcgggacgtccgtacgtagggttacggggaacgtcgaacgcccggtaatcccgacgccgtcggccgggacgtccgtgggtcgggggcgtacgggttccgacggcccgaacgggtcccttcccgggttcccccgttccgggtccctacccggttcccgttcccggttccccccgttccccgttccccgttcccgtaacccggg

SEQ ID NO: 392517 - DNA, 726 bp, Homo sapiens
  misc_feature: GZ8MTXP01D3R39.19.80.H03.1.454.CMB.2.raw
  modified_base (223)..(223): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggacgtggggtgtactgtaacagccctgctggcgagagggaccagggccaccgtcctcgagggacncccatgctgcaagtcgtgccagaggtcgcccctgaacctgaacggccaatgaacgacccaagacaggccaagtgggtgtgacgaccccgtgaggagcgtcggccctggtcccaggcagcgctcggccctgctgctcgcgtgggtctggccaagtcggtccgccctagtcggcctgcgtcgcccgaccctaagtcggttcgaccaccggacgaaaacgggcccgggggaacccacgggaccccgacgggacgtacccgtacgacgggggttacggaacgccgaaacggcccgtaacgtaccccgaacggtccccgtacgggtacccgggaacggtccccgttggggggtaacggggccgttaacgggggtacccgaaacgggtacccccgtaaaacggggccccgttcccgggttccccccccgttaacgggggtacccctaacccggtttccccgtccccgggtttccccccgtccccccgtttccccgttaaacccccgggg

SEQ ID NO: 392518 - DNA, 581 bp, Homo sapiens
  misc_feature: GZ8MTXP01DFWG2.19.80.H03.1.454.CMB.2.raw
  modified_base (218)..(218): a, c, t, g, unknown or other
  modified_base (242)..(242): a, c, t, g, unknown or other
  modified_base (267)..(267): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagganccatgctgcaagtcggcagaggtncccctgaacctgaaggccaaatganaccaagacaggccaagtggttgtgacgacccctgaggagcgtgggccctggtcccaggcagcgctcggcccctgctgctgcctgggtctggccagtcggtcgcccgatcggcctgcgtgccgacccaagtcgttcgccaccgacgaaacggacccggggaacccacggacccgtcggacgcctacgacgttcggggaacgtcgacgccgactccgacgcctaggccggtagccgtggtggggcagggttcgacgcccgaaggccgttcgccccgttcggtccactccgtcgtccccgcctcccgttccgaaccg

SEQ ID NO: 392519 - DNA, 572 bp, Homo sapiens
  misc_feature: GZ8MTXP01DLWEQ.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaaatgagacccaagacaggccaagtgggttgtgagacccctgaggagctgggcccctggtcccaggcagcgctggcccctgctgctgcctggggtctggcccagtcgggtcgccccgatcgggccctgctgcgcccaatggttgcaccgcaaacgcggggacccagaccctggacgcctcagttggggaacgcagccgatcccgagccctaggccggagcccgtggtgggggcagggttcacggccccgaaagggccttcggcccccttcgggtccacgtcctcgtccccaccctcccttccgaacg

SEQ ID NO: 392520 - DNA, 606 bp, Homo sapiens
  misc_feature: GZ8MTXP01CNSYM.19.80.H03.1.454.CMB.2.raw
  modified_base (167)..(167): a, c, t, g, unknown or other
  modified_base (217)..(217): a, c, t, g, unknown or other
  modified_base (262)..(262): a, c, t, g, unknown or other
  modified_base (287)..(287): a, c, t, g, unknown or other
  modified_base (372)..(372): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtntactgtaacagccctgctggcgagagggaccaggcaccgtcctccagganccatgctgcaagtcggcagagtgccctgaacctgaagccaatganacccaagacaggccaagtgggttgngacgacccctgaggagcgtgggcccctggtccccaggcagcgctcggcccctgctgctgccctgggtctggcccagtcgggtccnccccgagttcgggcccttgcctcggcctacccgaacgtcgtcgcgaccgacgaaacggaccgggacccgacgcccgtaaaaacggcgcctacgacgttaggggaacgcgacgccgacgccgacgccgacgccggtacgcccgtggtcgggcgaacggcgacgccgaacggccgttccgccccgttccggtccaccgtcctccgttcccttacccctccccgttccgtaacccgg

SEQ ID NO: 392521 - DNA, 696 bp, Homo sapiens
  misc_feature: GZ8MTXP01CBJXZ.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtcgcccctgaacctgaacggccaatgagacccaagacagccaagtggttgtgagacccctgaggagcgtcgggccctggtcccaggcagcgcgtcggcccctgctgctgccgtgggtctggccagtcgggtccgcccgagtcgggcccttgccgttcgggcccgtaccccgtaagttcgggttacggaccgacccggaccgaaaacggggcccgggggaaaccccgaacggaccccgtgggaccgaccgtcgtaacggttaccggggaacgccgaacggacccgacgtcccgaacggcccgtacgggccggacggcccgtggggtcggggccgtacgggttccgacggccccggaaacggccccttcccgggcccccgttccgggtccctacccgtttcccgttacccggttcccccttaccccgttccccgttaaccccgtaacccggg

SEQ ID NO: 392522 - DNA, 672 bp, Homo sapiens
  misc_feature: GZ8MTXP01D4KT4.19.80.H03.1.454.CMB.2.raw
  modified_base (220)..(220): a, c, t, g, unknown or other
  modified_base (245)..(245): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagagtnccctgaacctgaaggccaaatgagacccaagacaggccaagtggttgtgagacccctgaggagcgtgggccctggtccccaggcagcgctggcccctgctgctgccgtgggtctggcccagtcggtcgcccgatcgggcctgctcggccgccctaagtcggttcgccgaaccgcgaaaacggccggggaccctaacggaccccgtgggaacgcccgtacgacggttacgggggaaacgccgacggacccgtaagtccccgaacggcccgttacgggccgggtacgtcccgggtgggtcgggggcctaacggggttccgaaccgggccccgaaagggtccccgttcccgggcccccctttcggggtcccctaccgttccccgttcccggttcccccggttaccccttccccgttccccgtaacccggg

SEQ ID NO: 392523 - DNA, 646 bp, Homo sapiens
  misc_feature: GZ8MTXP01ERJ8B.19.80.H03.1.454.CMB.2.raw
  modified_base (222)..(222): a, c, t, g, unknown or other
  modified_base (384)..(384): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcggccagagtcgcccctgaacctgaaggccaaatgacgacccaagacaggccaagtgggttgtagacgacccctggaggagcgtcggggccctgggtcccaggcagcgctcggccctgctgctgcctgggtctggcctagtcggtccncccgagtcggcctgctcgccgtcccagtcggtcgaccgaccgacgaaacggccggggacccacgacccgtggactcctacgaggttacgggaacgcgacgcccgaatcccgaagcccgtaggcccgggagtcccggtgggtcggggcgagggttccgaaccggttaccccgaagggtccccgttacccggttcccccgttcgggtcccctaccgtttcccgttacccgttcccccttacccctccccgttaacccgaaccgg

SEQ ID NO: 392524 - DNA, 605 bp, Homo sapiens
  misc_feature: GZ8MTXP01BMXSZ.19.80.H03.1.454.CMB.2.raw
  modified_base (168)..(168): a, c, t, g, unknown or other
  modified_base (222)..(222): a, c, t, g, unknown or other
  modified_base (266)..(266): a, c, t, g, unknown or other
  modified_base (290)..(290): a, c, t, g, unknown or other
  modified_base (304)..(304): a, c, t, g, unknown or other
  modified_base (369)..(369): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaagtcggcagagtgccctgaacctgaagccaaangagaccaagacaggccaagtggtngacgccctggaggngcgtcgggccctggcccaggcagcgctcggccctgctgctgccgtggtctggccctgtcggtccnccgagtcggcctgctcgccgcccagtcgtcgcgaccgacgaaacggccgggacccagacccgtggacgcctacgacggttaggggaacgcgacggccgaactcccgagtccgtcggcggtacgccgtgggcggggcgtaggttccgacggcccgaacgggtcccttccggcccccgttcggtccctaccgttcccgttcccggttcccccgccccgttcccgttcccgtaaccggg

SEQ ID NO: 392525 - DNA, 621 bp, Homo sapiens
  misc_feature: GZ8MTXP01D7EFY.19.80.H03.1.454.CMB.2.raw
  modified_base (220)..(220): a, c, t, g, unknown or other
  modified_base (245)..(245): a, c, t, g, unknown or other
  modified_base (264)..(264): a, c, t, g, unknown or other
  modified_base (267)..(267): a, c, t, g, unknown or other
  modified_base (289)..(289): a, c, t, g, unknown or other
  modified_base (528)..(528): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagagtnccctgaacctgaagccaanganaccaagacaggcaagtggttgngagacccctgaggagcgtgggccctggccccaggcagcgctcggcccctgctgctgcctgggtctggcctagtcggtcgcccgatcggccctgcctcggcgtcccaagtgtcgcaccgcgaaacggccggggacccaggaccccgtggacgccgtacgtacggttacggggaaacggccgaaacggcccgaacgtccccgaacgcccgtaggccggtaggcccgttgggcggggaacgngggttccgacggcccgaaacgggtcccgttccggcccccgttacgggtcctaccttccgtcccggtccccaccccgtcccttcccgtaaccgg

SEQ ID NO: 392526 - DNA, 662 bp, Homo sapiens
  misc_feature: GZ8MTXP01AG8YO.19.80.H03.1.454.CMB.2.raw
  modified_base (249)..(249): a, c, t, g, unknown or other
  modified_base (364)..(364): a, c, t, g, unknown or other
  modified_base (617)..(617): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagggacgcccatgctgcaagtcgggccagaggtcnccctgaacctgaagccaatgagacccaagacaggccaagtgggttgtgagacccctggaggagctggggcccctggtccccaggcagcgctcggccctgctgctggcctgggtcncggcagtcgggtccgccctagtcgggcctggctcggccgcccgtaatcgggttcgccgaaccggaccgaaacggaccgggggaaccccacgggacccctacggggaacgtcccgtacgtacggttcgggggaaacggccgacggcccgaacgttccccgaaggcccgttacggccggggacgcccggttcgggtcgggggcacggggttccacggccccgaaagggcccttccgggcccccgttcgggtcccnccgttccgtcccgttccccgggccccttcccgttccgtaacccgg

SEQ ID NO: 392527 - DNA, 695 bp, Homo sapiens
  misc_feature: GZ8MTXP01BHST3.19.80.H03.1.454.CMB.2.raw
  modified_base (220)..(220): a, c, t, g, unknown or other
  modified_base (349)..(349): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctgaacctgaaggccaatgagacccaagacaggccaagtgggttgtgagacccctggaggagcgtggggcccctggtccccaggcagcgctggccccngctgctgcctggggtctggcccagtcgggtccgcccgagtcgggcccttgcctggaccgccctaagtcggttcgccaccggacgaaacggccgggggaaccccaggaccccgtagggacgcccgtacgacggttcggggaaacgcgaaacgcccgggaactcccgaacgcccgtacgggccgggaacggtcccggtggggtcgggggaaccgtacggggttccgaaaccgggccccgaaacggggtccccgttcccgggttcccccccgttaccgggggtcccctacccgttcccgttcccggtttccccccggccccctttaaccccgttccccgtaaacccggg

SEQ ID NO: 392528 - DNA, 565 bp, Homo sapiens
  misc_feature: GZ8MTXP01BD3FM.19.80.H03.1.454.CMB.2.raw
  modified_base (178)..(178): a, c, t, g, unknown or other
  modified_base (221)..(221): a, c, t, g, unknown or other
  modified_base (242)..(242): a, c, t, g, unknown or other
  modified_base (245)..(245): a, c, t, g, unknown or other
  modified_base (259)..(259): a, c, t, g, unknown or other
  modified_base (262)..(262): a, c, t, g, unknown or other
  modified_base (384)..(384): a, c, t, g, unknown or other
  modified_base (521)..(521): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacngccctgctggcgagagggaccagggcaccgtcctccgagggancccatgctgcaagtcggcagngtnccctgactgagcanganaccagacagccaagtggtgtgagacccctgaggagctgggccctggtcccaggcagcgctggccctgctgctgcctgggtctggccagtcggtcgcccagtcggcctgctcgcgcccatgtncacgcgaacgcgggacccagacccgtggacgcctcgacgttggggaacgcgagccgatcccgagccgtgccggacgccgtggtcggggcacggttcgacggcccgaagggtcccttcggcccccttcgggtaacccnccgttcccgtccggttccccgcccctcccgttcccgtaacccgg

SEQ ID NO: 392529 - DNA, 666 bp, Homo sapiens
  misc_feature: GZ8MTXP01A6WDR.19.80.H03.1.454.CMB.2.raw
  modified_base (220)..(220): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtncccctgaacctgaacggccaatgagacccaagacaggccaaggtgggttgtgagacccctggaggagcgtgggcccctgggtccccaggcaggcgcgtcggcccctgctgctgccgtgggtctggccagtcggtccgcccagtcggcctgctcggccgccctaagtcggttacgccgaccggacgaaacgggcccggggaacccacggaccccgtcggacgccgtacgtaacgggttggggaacggcgaacggccgacgtcccgacgcccgttgggccggtacggtccgtacgggtcgggggctacggggttccgaccgggcccgaaacgggtcccgttccggttcccccgttccggggtcctacccggttcccgttcccggtttacccccaccccgttcccgttaacccgtaacccggg

SEQ ID NO: 392530 - DNA, 563 bp, Homo sapiens
  misc_feature: GZ8MTXP01C74U7.19.80.H03.1.454.CMB.2.raw
  modified_base (220)..(220): a, c, t, g, unknown or other
  modified_base (246)..(246): a, c, t, g, unknown or other
  modified_base (483)..(483): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtncccctgaacctgaaggccaatgagacccaagacaggccaagtgggttgtgagacccctgaggagctgggccctggtcccaggcagcgctggccctgctgctgcctgggtctggccatcggtcgcccatcggcctgctgcgcccatgtgcacgcgaaacgcggggacccagaccctggacgcctacaggttggggaagcgagccgatcccgagccgtagcggagccgtggtgggggcngggttccgacggcccgaaaggccttcgccccgttacgggtccaccgttcctccgtccccgccctcccgttccgtaaccgg

SEQ ID NO: 392531 - DNA, 778 bp, Homo sapiens
  misc_feature: GZ8MTXP01AMGP5.19.80.H03.1.454.CMB.2.raw
  modified_base (248)..(248): a, c, t, g, unknown or other
tcagtactctcgtgcacgaccggtgctcgatttagctgtgcgtcgaagggaaaggggcccgtctgggagagatccccaggggtgacagccatggaccctggaagggcccgggctagggacagggaccagagccagtccagggagaggacagagccaatggactggggtgtactgtaacagccctgctggcgagagggaccagggcaccgtcctccagggagcccatgctgcaagtcgggccagaggtncccctgaacctgaaggccaaatgagacccaagacaggccaagtgggttgtgagacccctgaggagctgggccctggtccccaggcagcgctcggcccctgctgctgctcgggtctaggccctagtcggtaccgcccctaagttcggggcccttggccgttcggaccggcccctaaagttcgggttcgaccgaacccggaccgaaaacgggcccgggggaaacccctacgggaacccccgttcggggaacggtcccttaccgaagtttacggggaaacggtcccgaacgggtacccgacgttaccccgaacggccccgttcgggaacccggggtacggccccggttaggggtaccggggggccgttaaaccgggggtcccgaaacggggtcccccgaaacgggggccccttacccgggaccccccccccgttgggggttccccctaacccgggtttccctttaaccccgggtttaccccccccccgtacccccggttacccccggtaaccccggttaacccgggtaacccg

SEQ ID NO: 392532 - DNA, 620 bp, Homo sapiens
  misc_feature: GZ8MTXP01CWMDG.19.80.H03.1.454.CMB.2.raw
  modified_base (220)..(220): a, c, t, g, unknown or other
  modified_base (509)..(509): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgccctgaacctgaaggccaaatgagacccaagacaggccaagtggtgtgagacccctgaggagctgggccctggtcccaggcagcgctcggcccctgctgctgccgtgggtctggccagtcgggtccgcccagtcgggcccttgcctcgccgacccctaagttcggttcgccgaccggaccgaaaacgggccgggggaaccccacggaccccgtacgggacgtcccgtacgaggttcggggaaacgccgaacgcccggaacncccgacgccgtacggcggtacgccggtgggtcgggaacgtacggcgaccgccgacggccgttcccgccccgttcgtcctccgtcctcccgtcccttccctccgccgtaacg

SEQ ID NO: 392533 - DNA, 428 bp, Homo sapiens
  misc_feature: GZ8MTXP01DCTYK.19.80.H03.1.454.CMB.2.raw
  modified_base (397)..(397): a, c, t, g, unknown or other
  modified_base (419)..(428): a, c, t, g, unknown or other
tcagtactctcgtgcacgaccggtgctcgatttagctgtgcgtcgaagggaaaggggctggagtgggtggccaacataaagccagatggaagtgagagatcttatgtggactctgtgaagggccgattcagcatctccagagacaacgccaagaattcacttgtttctgacaaaataaacagcctgagagccgaggacacggctgtctactattgtgtgagagaggataaagaattacttttgatttcgtgggggccaggggacaacggtcaccgtctctcagcctccaccaacggcccatccggtccttcccccgtggccgcccctgcctccaggacgccacctcgagacgcacacgcggcctgggctgcctgtcaagctactcccagagagtacngagcggctggcaggcgcatagnnnnnnnnnn

SEQ ID NO: 392534 - DNA, 626 bp, Homo sapiens
  misc_feature: GZ8MTXP01C2BFX.19.80.H03.1.454.CMB.2.raw
  modified_base (217)..(217): a, c, t, g, unknown or other
  modified_base (242)..(242): a, c, t, g, unknown or other
  modified_base (285)..(285): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggacagggcaccgtcctccaggancccatgctgcaagtcggccagagtnccctgaacctgaaggccaaatgagaccaagacagcaagtggtntgagaccctgagagcgtgggccctggtcccaggcagcgctcggcccctgctgctgcctgggtctggccagtcggtcgcccagtcggccttgctcgccgcccgtaagtcggtcgaccgaccggacgaaaacgggccggggaaccccaggtaccccgtggactccgtacgaggttcggggaacgcgaacggcccgtaatcccgacgcccgtaggccggacggtcccgtgggtcggggccgagggttccgaacggccccgaaagggtccgttacccggcccccgttcgggtcccctacgttcccgttcccggttccccttaccccttcccgaacccgtaaccgg

SEQ ID NO: 392535 - DNA, 573 bp, Homo sapiens
  misc_feature: GZ8MTXP01BDUM6.19.80.H03.1.454.CMB.2.raw
  modified_base (219)..(219): a, c, t, g, unknown or other
  modified_base (244)..(244): a, c, t, g, unknown or other
  modified_base (496)..(496): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagagtnccctgaacctgaaggccaatgagacccaagacaggccaagtgggttgtgagacccctgaggagctgggcccctggtccccaggcagcgctggcccctgctgctgcctgggtctggcccagtcgggtccgcccatcgggccctgcctgcgcccaagtgtcgcaccgcaaaggccgggggacccagacccgtggacgcctacgacggttggggaacgcgaagcccggatcccgagcccgtggccggagccgtgngggggcagggttcaaggccccgtaaagggccttcgccccttggtccacgtccgttccccgcccttcccctccgcgcg

SEQ ID NO: 392536 - DNA, 666 bp, Homo sapiens
  misc_feature: GZ8MTXP01BFMDL.19.80.H03.1.454.CMB.2.raw
  modified_base (219)..(219): a, c, t, g, unknown or other
  modified_base (241)..(241): a, c, t, g, unknown or other
  modified_base (245)..(245): a, c, t, g, unknown or other
  modified_base (369)..(369): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggancccatgctgcaagtcgggcagnggtnccctgaacctgaagccaatgagacccaagacaggccaagtgggtgtgagacccctgaggagctggggccctggtccccaggcagcgctggcccctgctgctgcctgggtctggccatcgggtcncccagtcggcctgctcgcgcccagtcggttgcaccgcaaacggccggggacccaggacccgtggacgccgttcgaggttcgggggaaacgcgaagccggaactcccgagtcccgtcggcgggaacgtcccggtgggtcgggggcccgaacggggttccgaaccggggccccgaaacgggggtccccgttacccgggccccccccggttccgggggttaacccctaccccggtttcccgttccccgggttttcccccccggcccccctttccccggttaacccccgtaaaccccgggg

SEQ ID NO: 392537 - DNA, 650 bp, Homo sapiens
  misc_feature: GZ8MTXP01BE3PB.19.80.H03.1.454.CMB.2.raw
  modified_base (242)..(242): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagnggtnccctgaacctgaaggccaatgagacccaagacaggccaagtgggttgtgagacccctggaggagcgtcgggcccctggtccccaggcacgcgctcggcccctgctgctgcctgggctggccagtcggtccgcccgagtcgggcctgctcgcccgcccgtaagttggtcgccgacccggcgaaaacggcccggggaaccccaggaccccgtgggacgcccgtacgaggttacggggaaacgccgaacggcccggaactcccgaacgtcccgtcggccggaacgtcccggtgggtcgggggcaacggggttccgaacggccccgaaagggcccttccggcccccgttcggggtccctccgttcccgttcccggttcccccggccccttcccgttccccgtaaccgg

SEQ ID NO: 392538 - DNA, 578 bp, Homo sapiens
  misc_feature: GZ8MTXP01DVEZQ.19.80.H03.1.454.CMB.2.raw
  modified_base (220)..(220): a, c, t, g, unknown or other
  modified_base (404)..(404): a, c, t, g, unknown or other
  modified_base (431)..(431): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaaatgagacccaagacaggccaagtgggttgtgagacccctgaggagcgtgggccctggtccccaggcagcgctggcccctgctgctgcctgggtctggcccatcgggtcgcccatcgggcctggctgcgcccaatgtncacgcgaaagccggggacccagacccnggacgcctacgtacggttggggaaacgcgagccgatccagccgtgcggagccgtggtggggcagggttccacggcccgaaagggtccttccggcccccttcgggtcctacgtccttccggtccccttaccctcccttccgtaaccgg

SEQ ID NO: 392539 - DNA, 566 bp, Homo sapiens
  misc_feature: GZ8MTXP01B1W1P.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctggggcccctggtccccaggcagcgctggcccctgctgctgcctgggtctggccatcggtcgcccatcggcctgctgcgcccatgttgcaccgcgaaacgccggggacccagaccccgtggacgcctcaggttggggaacgcgagccgatcccagccgtgcggagcccgtggtggggcagggttcacggcccgaaacggccttcgcccccttcggtccaccgtccttcgtccccacccgtcccttccgaaccgg

SEQ ID NO: 392540 - DNA, 598 bp, Homo sapiens
  misc_feature: GZ8MTXP01D1Z2F.19.80.H03.1.454.CMB.2.raw
  modified_base (221)..(221): a, c, t, g, unknown or other
  modified_base (248)..(248): a, c, t, g, unknown or other
  modified_base (442)..(442): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggacccagggcaccgtcctccagggancccatgctgcaagtcgggccagaggtncccctgaacctgaaaggccaaatgagacccaagacaggccaagtgggttgtgagacccctgaggagcgtgggccctggtcccaggcagcgctggccctgcctgctgcctgggtctggcccagtcggtcgccctagtcgggccctgctcgcgcccagtggttcgcaccgcgaaacggccggggacccagacccgnggacgccgtagacggttggggaacgcgaacgccgatccgagtcccgaggccggtagcccgtgggtggggctagggttcacggcccgaagggccttccggcccccgttcggtcctccgtccgttccggtccccgttcccctcccgttccgtaaccgg

SEQ ID NO: 392541 - DNA, 604 bp, Homo sapiens
  misc_feature: GZ8MTXP01CZCYL.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgccctgaacctgaaggccaatgagacccaagacaggccaagtgggttgtgacgacccctgaggagctggggcccctgggtccccaggcaggcgcgtcggcccctgctgctggcctgggtctggccagtcggcgcccagtcggcctgctcgcgcccagtgtcgcacgcgaaacggcgggacccacgacccgtcggacgcgtcgaggttacggggaacgcgacgccgactcccgacgccgtcgcggacgccgtcgggtcggggcgacgggttcgacggacccgaacgggccgttacccggccccgttccggtccctaccgtccgttcccggttccccgcccctcccgttcccgtaaccgg

SEQ ID NO: 392542 - DNA, 637 bp, Homo sapiens
  misc_feature: GZ8MTXP01DG32T.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaaatgagacccaagacaggccaagtgggttgtgagaccccctgaggagctggggccctggtccccaggcagcgctggcccctgctgctgcctgggtctggccatcggtcgcccgatcgggcccttgcctcgacgccccaatggttcgcaccgcgaaagaccgggggacccaggaccccgtggacgccgtacgaggttcgggggaaacgcgaacgcccgaacgttccccgaaggccccgtaggccgggacgtcccgtgggtcgggggcacgggttccgacggccccgaaagggccccttcggccccccttccggggtccctacccgttcccggtttcccccgccccgttccccgttcccgaaccggtaaccgg

SEQ ID NO: 392543 - DNA, 620 bp, Homo sapiens
  misc_feature: GZ8MTXP01EGFQU.19.80.H03.1.454.CMB.2.raw
  modified_base (219)..(219): a, c, t, g, unknown or other
  modified_base (244)..(244): a, c, t, g, unknown or other
  modified_base (448)..(448): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggancccatgctgcaagtcggcagaggtnccctgaacctgaaggccaaatgagacccaagacaggccaagtgggttgtgagacccctgaggagctgggccctggtcccaggcagcgctggcccctgctgctgccgtgggtctggcccagtcgggtccgcccgatcgggccctgcctcggcgtccccaaagtggttcgccgaccgcaaaacggccggggacccacggaccccgnggaacgccctacgaggtttcgggggaaagcgaacgccggaatcccgagccgtggcgggtacgcccgttggcgggggcagggttccacggacccgaaagggccgttccggcccccgttccgggtccaccttccgttccggttcccccgccccttccccgttcccgaacccggg

SEQ ID NO: 392544 - DNA, 648 bp, Homo sapiens
  misc_feature: GZ8MTXP01AM2HW.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggaggtcgcccctgaacctgaacgccaatgagacccaagacaggccaagtgggtgtgagacccctgaggagctggggccctggtcccaggcagcgctcggcccctgctgctgcccttgggtctggccagtcgggtccgcccagtcgggccttgcctcggccgccctaagtcggttcgccgaaccggaccgaaacggcccgggggaaccccgacggaccccgtcgggaacgtcccgtacgacggtttacggggaaacgcgacgacccgactcccgacgcccgtaggccggacggtcccgtgggtgggggccaagggttccgacggcccgaaacggccgttccggcccccgttcgggtccaccgttcccgtaccgttccccaccccttcccgttcccgtaaccggg

SEQ ID NO: 392545 - DNA, 681 bp, Homo sapiens
  misc_feature: GZ8MTXP01DAJ3D.19.80.H03.1.454.CMB.2.raw
  modified_base (170)..(170): a, c, t, g, unknown or other
  modified_base (271)..(271): a, c, t, g, unknown or other
  modified_base (294)..(294): a, c, t, g, unknown or other
  modified_base (306)..(306): a, c, t, g, unknown or other
  modified_base (309)..(309): a, c, t, g, unknown or other
  modified_base (368)..(368): a, c, t, g, unknown or other
  modified_base (372)..(372): a, c, t, g, unknown or other
tcagtactctcgtgcacgaccggtgctcgatttagctgtgcgtcgaagggaaagggggcccgtctgggagagatccccaggggtgacagccatggaccctggaagggcccggctagggacagggaccagagccagtccagggagaggacagagccaatggacttggggtntactgtaacagccctgctggcgagagggaccagggcaccgtcctccgagggagcccatgctgcaagtcgggccagaggtgcccctgaacctgaacgccaangagacccaagacagcaagtggtngagccctgaggngcnggccctggcccgaggcagcgctcggcccctgctgctgcgtcggctggcctatcggtccncccngtcgggccctggcctcgccgcccaagtcgttcgaccaccgacgaaaccggcccggggaaaccccacggtaccccgtacgggaacgccccgttacgaacggttacggaaacggtacccgaacgcccgaaaccgtcccgaacggcccgtcggacccggacggtcccgtgggttccggggcgtaacgggtccgaccgggccccgaaacgggtccccgtcccggttcccccgttccgggttaccctaacccgttcccgtttaacccgttccccccgtaccccgttccccgttaaccccgaaccggtaacccgg

SEQ ID NO: 392546 - DNA, 611 bp, Homo sapiens
  misc_feature: GZ8MTXP01AGRKI.19.80.H03.1.454.CMB.2.raw
  modified_base (250)..(250): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggagcccatgctgcaagtcgggccagaggtcncccctgaacctgaaggccaaatgagacccaagacaggccaagtggttgtgacgacccctgaggagcgtcggggcccctggtccccaggcagcgctcggcccctgctgctgcctgggtctggccagtcggtcgcccgagtcgggcctgctcgcgcccaatcggttcgccgaccggacgaaaacgggccggggaaccccacggaccccgtcgggacgtcccgtacgacggttaggggaacgccgacgcccgaatcccgagccgtggtcggacgcgtggtgggcaggttcacggcccgtaacggccttccgccccgttcggtcctccgtccgttccgtccccacccttcccgttccgtaaccgg

SEQ ID NO: 392547 - DNA, 641 bp, Homo sapiens
  misc_feature: GZ8MTXP01EUI7Q.19.80.H03.1.454.CMB.2.raw
  modified_base (273)..(273): a, c, t, g, unknown or other
  modified_base (332)..(332): a, c, t, g, unknown or other
  modified_base (578)..(578): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaaggtcgggccagaggtgcccctgaacctgacgccaatganacccaagacaggccaagtgggttgtgagacccctgaggagcgtgggcccctggtccccnggcaggccgctcggcccctgctgctgccctgggtctggcctagtcgggtccgcccgagtcgggccctcgcgttcggccgcccaagtcggttacgccgacccgacgaaacgggacccgggggaccccgaacgaccccgacgggaccgacccgttaccgacggttacgggggacgcgaacgcccggactcccgacgccgtcggccggacccgtcgggcggggcgaacgggcgacgccgaacggccgtnaacccccgttcccgttagcccctgtcccgtttcccgaccccttccgttccccaacggtaaccg

SEQ ID NO: 392548 - DNA, 612 bp, Homo sapiens
  misc_feature: GZ8MTXP01DQGVB.19.80.H03.1.454.CMB.2.raw
  modified_base (220)..(220): a, c, t, g, unknown or other
  modified_base (513)..(513): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggganccatgctgcaagtcgggccagaggtgcccctgaacctgaaggccaaatgagacccaagacaggcaagtggttgtgagacccctggaggagcgtggggccctggtccccaggcagcgctggcccctgctgctgcctggggtctggccagtcggtcgcccgatcgggccctgctcgccgcccaagtcggttgacgaccgacgaaacggcggggaccccaggacccgtggacgcctgacgtggggaacgcgacgccgactcccgagccgtacggcggacgcccgtgggtcggggcncgggttacgacggcccgaaacgggcccttccgggccccccttcgggtccctaccgttccgttcccggttccccaccccttcccgttcccgtaaaccggg

SEQ ID NO: 392549 - DNA, 606 bp, Homo sapiens
  misc_feature: GZ8MTXP01AGD04.19.80.H03.1.454.CMB.2.raw
  modified_base (220)..(220): a, c, t, g, unknown or other
  modified_base (248)..(248): a, c, t, g, unknown or other
  modified_base (410)..(410): a, c, t, g, unknown or other
  modified_base (435)..(435): a, c, t, g, unknown or other
  modified_base (447)..(447): a, c, t, g, unknown or other
  modified_base (465)..(465): a, c, t, g, unknown or other
  modified_base (493)..(493): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcncccctgaacctgaacggccaatgagacccaagacaggccaaagtgggtgtgagacccctgaggagctgggccctggtcccaggcagcgctggcccctgcctgctgcctggggtctggccctagtcgggtccgcccagtcggcctgctcgccgcccatggtcncgaccgcgaaacggccggggacccnggaccctggacncgtcgaggttggggaacncgacgccgactccgagccttggaccggngtccggtggtcggggcgcggttcgacggcccgtaacggccgttcccggcccccgttccgggtccctaccgttcccgtccggttcccccaccccttcccttcccgtaaccccgg

SEQ ID NO: 392550 - DNA, 646 bp, Homo sapiens
  misc_feature: GZ8MTXP01CCE9N.19.80.H03.1.454.CMB.2.raw
  modified_base (168)..(168): a, c, t, g, unknown or other
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgaggganaccatgctgcaagtcgggccagagtcgccctgaacctgaacggccaatgagacccaagacaggccaagtggttgtgagacccctgaggagctgggcccctggtccccaggcagcgcgtcggcccctgctgctcgccgtgggtctggcccagtcgggtccgcccagtcgggccctggcctcggccgcccgtaagttcggttcggaccgaccggacgaaacgggaccggggacccacgacccgtgggacgccgtcgaggttacggggaacgcgacgccgaacgtcccgacgccgtggcggacggtcccgtgggtcgggcgtagggttccgacggcccgaaagggtcccttacccggcccccgttacgggtcccgtacccgttccgttcccggttaccccaccccgtttcccgaacccgtaacccggg

SEQ ID NO: 392551 - DNA, 605 bp, Homo sapiens
  misc_feature: GZ8MTXP01DZKGT.19.80.H03.1.454.CMB.2.raw
  modified_base (219)..(219): a, c, t, g, unknown or other
  modified_base (245)..(245): a, c, t, g, unknown or other
  modified_base (434)..(434): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcaggganccatgctgcaagtcgggccagaggtnccctgaacctgaaggccaaatgagaccaagacaggccaagtggttgtgagacccctgaggagcgtcgggccctggtcccaggcagcgctcggcccctgctgctcgcctgggtctggccagtcggtcgccgatcggcctgctcgcgcccaagtggttcgcacgcgaaaggccggggacccacgaccccgnggaccgcctacgacggttacggggaaacgcgacgcccggaatcccgaacggccctggccggtacggcccgttgggcggggctaacgggccacggcccgtaaaggcccttcggcccccgttcggtaaccgtccttccgttccgttcccccgcccttcccttcccgtaaccgg

SEQ ID NO: 392552 - DNA, 609 bp, Homo sapiens
  misc_feature: GZ8MTXP01DEB87.19.80.H03.1.454.CMB.2.raw
  modified_base (221)..(221): a, c, t, g, unknown or other
  modified_base (489)..(489): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcggccagaggtgccctgaacctgaaggccaaatgagaccaagacaggccaagtggtgtgagacccctgaggagcgtgggccctggtcccaggcagcgctcggcccctgctgctgccgtgggtctggccagtcggtcgcccagtcgggcctgcctcggcgcccaagttcggttcgccgaccgacgaaacgggccggggaacccacggacccgtggaacgtccgtacgaggttacggggaacgcgacgacccgaancccgagccgtaggcggacgtccgtggcggggcaggccgacgccgaaacggtcccgccggttccccttacgggtcctaccgtccttaccggtccccttacccgtccgttaacccgaaccgg

SEQ ID NO: 392553 - DNA, 629 bp, Homo sapiens
  misc_feature: GZ8MTXP01A7QZP.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcggcagaggtgccctgaacctgaaggccaatgagacccaagacaggccaagtggtgtgagacccctgaggagcgtgggccctggtccccaggcagcgctcggcccctgctgctggcctggggtctggccagtcgggtccgcccgagtcgggcctgcctcgccgccctagtcggtgccgaccgcgaaacggccggggaacccacggacccgtggacgccgtcgagttacggggaacgcgacgccgactcccgacgccgtacggccggacggtccgtcgggtcggggccgtacgggttccgacggccccggtaaacggccccgttaccggcccccgttcggtccctaccgttcccgttccgttcccccgccccttcccgttaacccgtaacccggg

SEQ ID NO: 392554 - DNA, 629 bp, Homo sapiens
  misc_feature: GZ8MTXP01DAH2F.19.80.H03.1.454.CMB.2.raw
  modified_base (219)..(219): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaaatgagacccaagacaggccaagtgggttgtgagacccctgaggagctgggccctggtcccaggcagcgctggcccctgctgctgcctgggtctggccagtcgggtcgcccagtcgggcctcggctcgccgcccgtaagtcggttacgccgaccgacgaaaacgggccggggaacccacggaccccgtggaccgccgtacgacggttggggaaacgcgacggcccgaatcccgacgccgtacgcggagcccgtggcggggcacgggttccgacggcccgaagggtcccttaccggttcccccgttcgggtccctacgttcccgttaccggttccccttaccccgttcccgttcccgtaaccggg

SEQ ID NO: 392555 - DNA, 661 bp, Homo sapiens
  misc_feature: GZ8MTXP01DQJCH.19.80.H03.1.454.CMB.2.raw
  modified_base (221)..(221): a, c, t, g, unknown or other
  modified_base (296)..(296): a, c, t, g, unknown or other
  modified_base (386)..(386): a, c, t, g, unknown or other
  modified_base (589)..(589): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgagggacnccatgctgcaagtcggccagaggtcgccctgaacctggaacggccaatgacgacccaagacaggcaagtggttgngacgacccctggaggacgcgtcgggcccctggtccccgaggcgacgccgctcggcccctgctgctgccgtgggtctggcctagtcggccnccgtagtcgggccctgccgtcggcctcccgtagtcggtacgccacggaccgaaacgggaccgggacccgtacggaccccgtggaccgtaccgtacgtaacggttacgggggaacgccggacggtacccgtacgtacccgacgccgtacggccggacgtccggtcgggcgggcgtacggttccgacggttacccgacggtcccncccggttccccgttaccggtcctaccgttcccgttcccgttccccttacccgtcccgttaaccgtaacccgg

SEQ ID NO: 392556 - DNA, 681 bp, Homo sapiens
  misc_feature: GZ8MTXP01CV23U.19.80.H03.1.454.CMB.2.raw
  modified_base (219)..(219): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgaggancccatgctgcaagtcggccagaggtcgcccctagaacctgaaggccaaatgacgaccaagacaggcaagtggtgtagacgaccctgaggagcgtcgggccctggtccccaggcagcgctcggcccctgctgctgccgtgggctggcctagtccgccgcccagtcggcctgcctcgccgacccgtaagttcggtacgccgaccgaaccgaaacgggccggggaaccccacggaccccgtagggaccgtccgtacgtacgggttacggggaaacgcgaacgcccggaactcccgaacggtcccgtacgggccgggtacggtcccggttggggtcgggggaaccgacggggttaccgaaccggaccccgaaacggggtcccttacccgggttcccccttcggggtaaccctacccgttcccgttccccggttcccccgttccccttcccgttcccgtaaaccggg

SEQ ID NO: 392557 - DNA, 676 bp, Homo sapiens
  misc_feature: GZ8MTXP01BXM63.19.80.H03.1.454.CMB.2.raw
  modified_base (376)..(376): a, c, t, g, unknown or other
  modified_base (390)..(390): a, c, t, g, unknown or other
  modified_base (510)..(510): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccagaggtcgcccctgaacctgaacggccaaatgaacgacccaagacaggaccaaggtgggttgtgacgacccctggaggagcgtcggggccctggcccaggcacgcgctcggcccctgctgctgccgtgggtcncggccagtcggccnccgagtcgggcctcgctcggccgtacccagttcggtcgccgaccggacgaaacggcccggggacccacggaccccgtaggacgcccgtacgtacggttacggggaacgcgacgccgtacnccgacgtccgacggccggtacggtcccgtgggtccggggcgtaaccgggttcgaccggttacccgaaccggggtcccttccccggttcccccgttcccggttaacccgtcccgttcccgttccccgttcccccgaccccgtttccccgttaaccccgtaaaccggg

SEQ ID NO: 392558 - DNA, 560 bp, Homo sapiens
  misc_feature: GZ8MTXP01AO25C.19.80.H03.1.454.CMB.2.raw
  modified_base (168)..(168): a, c, t, g, unknown or other
  modified_base (221)..(221): a, c, t, g, unknown or other
  modified_base (297)..(297): a, c, t, g, unknown or other
  modified_base (311)..(311): a, c, t, g, unknown or other
  modified_base (396)..(396): a, c, t, g, unknown or other
  modified_base (420)..(420): a, c, t, g, unknown or other
  modified_base (425)..(425): a, c, t, g, unknown or other
  modified_base (439)..(439): a, c, t, g, unknown or other
  modified_base (448)..(448): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacncccatgctgcaagtcgggccagaggtcgcccctgaacctgaagccaatgagacccaagacaggccaagtgggttgngagacccctgaggngctgggccctggcccaggcagcgctcggcccctgctgctgcctgggctggccagtcgtccgccagtcggcctgctgcgccatgtncgacgcaaggcgggaccacgaccnggacncctgagtgggaacncgagccganccgagccgcggcggtacgcgtggcggggcacggttcgaacgcccgaaaggtcccttccgccccgttacggtccaccgttcctcccgtccccgcccctccgttcccgaaccgg

SEQ ID NO: 392559 - DNA, 651 bp, Homo sapiens
  misc_feature: GZ8MTXP01DW5LI.19.80.H03.1.454.CMB.2.raw
  modified_base (168)..(168): a, c, t, g, unknown or other
  modified_base (220)..(220): a, c, t, g, unknown or other
  modified_base (360)..(360): a, c, t, g, unknown or other
  modified_base (375)..(375): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaagtcgggccagaggtgcccctgaacctgaaggccaatgagaccagacaggccaaggtggttgtgacgacccctgaggagcgtgggcccctggtccccaggcagcgctcggccctgctgctgcgtggtcnggcccagtcggtccnccctagtcgggccttcgccgtcggccgtacccgtaacgtcggttcgaccgaccggacgaaacgggaccggggaaccctacggaccccgtggacgccgtacgacggttacggggaacgtcgacgccgtaacgccgacgccgtacggccggtacgtccggtggtcgggggcgacgggttccgaccggacccgaaccggtccgttacccggttccccgttcccgggtcctacccgttccgttcccgttccccgttccccgttcccgttcccgtaaccgg

SEQ ID NO: 392560 - DNA, 650 bp, Homo sapiens
  misc_feature: GZ8MTXP01CAHRY.19.80.H03.1.454.CMB.2.raw
  modified_base (219)..(219): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggngcccatgctgcaaggtcgggccagaggtcgcccctgaacctgaacggccaaatgagacccaagacaggccaagtggttgtgacgacccctggaggagcgtcggggccctggtccccaggcagcgcgtcggccctgctgctgtccgtgggtctggccagtcggtccgcccgagtcggcctgccgtcgccgcctagtcgtcgccgaccgacgaaacgggccgggaacccgacggacccgtaggaccgtccgtacgacggttacgggggaacgccgacgacccgacgtcccgacgccgtacggccggtacggcccgtgggcggggtaacgtcgggttccgaccggaccgaacgggtcccgttcccggttccccgttcggtccctaccgttcccgtcccgttcccccttaccccgtcccgttcccgtaacccggg

SEQ ID NO: 392561 - DNA, 639 bp, Homo sapiens
  misc_feature: GZ8MTXP01A4GK0.19.80.H03.1.454.CMB.2.raw
  modified_base (218)..(218): a, c, t, g, unknown or other
  modified_base (242)..(242): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcaggancccatgctgcaagtcggcagagtnccctgacctgaagccaatgacaccaagacacggaccaaggtgggttgtagacgacccctggaggagcgtgggcccctggccccaggcagcgctcggcccctgctgctgccgtgggtctcggcctagtcggtccgcccgagtcgggccctggccgtcggacgaccccgtaagtcggtcgaccgaccgaccgaaacgggaccggggacccacggaccccgtagggaccgccgtacgacggttacggggaacgtcgacgccggactcccgacgccgtacggccgacgtcccgtgggcggggcgacggttcgaccggcccgaaacggtccgttcccggcccccgttcggtccctaccgttcccgttccccgtccccgttcccctccccgttcccgtaaccg

SEQ ID NO: 392562 - DNA, 610 bp, Homo sapiens
  misc_feature: GZ8MTXP01EW2SC.19.80.H03.1.454.CMB.2.raw
  modified_base (505)..(505): a, c, t, g, unknown or other
tcagtactctcgtgcacgaccggtgctcgatttagctgtgcgtcgaagggaaaggggccctctgggagagatccccaggggtgacagccatggaccctggaagggcctgggctatggacagggaccagagccagtccagggagaggacagagccaatggactggggtgtactgtaacagccctgctggcgagagggaccaggcaccgtcctccagggagcccatgctgcaagtcggccagaggtgcccctgaacctgaaggccaatgagacccaagacaggccaagtgggttgtgagacccctgaggagcgtggccctggtcccaggcagccgcgtcggcccctgcgtgctgcgtggtctggccaagtcggtcgcccagtcggcctgctcgcccgccctaagttcgggttcgcgaccggacgaaacgggccggggaacccacgggaccccgtgggacgcccgtcgacggggttggaaacgcgacgcccgaacgtccgacgtccgngtccgggacgcccgttagggcgggcgagggtccgacggcccgaagccgttccggcccccgttcggctaaccgtccgtccgttccccaacccgttcccgtaacccg

SEQ ID NO: 392563 - DNA, 715 bp, Homo sapiens
  misc_feature: GZ8MTXP01D5ZRW.19.80.H03.1.454.CMB.2.raw
  modified_base (221)..(221): a, c, t, g, unknown or other
  modified_base (399)..(399): a, c, t, g, unknown or other
  modified_base (691)..(691): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgagggacncccatgctgcgaaggtccgggccaggacggtcgcccctagaacctgaacggccaaatgaacgacccaaagacaggccaaggtgggttgtagacgacccctggaggagcgtcggggccctggcccaggcagcgcgtcggcccctgctgctcggtccgtgggtctggccagtcgggtccncccgagtccgggccctggccgtcggccgtacccgtagttcgggtacgaccgaaccggaccgaaacggggacccggggaacccacggtacccggacggacgtccgtacgtaacgggttacgggggaaacgccggaacggccccgaacgtccccgaacgcccggttacgggcccggtacgggtcccgggttcggggcgggggaaccgtacgggacccgacggaccccgaacgggtccccgttacccggttcccccggttcgttaacccgtcccgttccgttcccggttcccccncccgttcccttaaccggtaaccgg

SEQ ID NO: 392564 - DNA, 645 bp, Homo sapiens
  misc_feature: GZ8MTXP01EURDO.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccagggccaccgtcctccgagggacgcccatgctgcaaggtcgggccagaggtcgcccctgaacctgaaggccaatgacgacccaagacaggccaagtgggtgtgacgaccccgtggaggagcgtggggccctgggtcccaggcagcgctggccctgctgctgcctgggtctggcctagtcgtcgccgagtcggccttgctcgccgccagtcggtcgccgaccggacgaaacgggccggggacccacgggacccgtggaccgtccgtacgtaggttacgggggacgcgacggccgtacgcccgacgcccgtagggccggtacggcccgttgggcggggtaacgcgggttccgacgggcccgaacgggtcccgccccgcccccgttcgggtccctacccgttcccttcccgttaccccgttcccctaaccccgttcccgtaacccggg

SEQ ID NO: 392565 - DNA, 643 bp, Homo sapiens
  misc_feature: GZ8MTXP01ET7C6.19.80.H03.1.454.CMB.2.raw
  modified_base (222)..(222): a, c, t, g, unknown or other
  modified_base (271)..(271): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcgggccagaggtcgcccctgaacctgaaggccaangacgaccaagacagcaagtgtgtgtgacgaccctgaggagcgtcggccctggtcccaggcagcgctcggcccctgctgctcgcgtgggtctcggccctaagtcggtccgcccgtagtcgggcctgccgtcgccgaccctaagtcggtcgccgaccgacgaaaccgggccggggaaccccacggacccgtggacgcctcgacggggttaggaacgcgacggaccacgtcccacggcccgtggccgggacgtcccggtgggtcggggcgttacgggaccaccggacccgtaacgggttcccgttaccggccccccgttcgggtaccctcccgttcccggtccccgttccccggtcccccttcccgtaaccccgg

SEQ ID NO: 392566 - DNA, 689 bp, Homo sapiens
  misc_feature: GZ8MTXP01CWQFB.19.80.H03.1.454.CMB.2.raw
  modified_base (218)..(218): a, c, t, g, unknown or other
  modified_base (293)..(293): a, c, t, g, unknown or other
  modified_base (406)..(406): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctcagggancccatgctgcaagtcggccagaggtcgcccctgaacctgaaggccaagtgacgacccaagacaggcaagtggtgngacgaccctggagagcgtcggggccctggtcccaggcaggccgcgtcggccctgctcgctgcccgtgggtctgggccagtcggtccgcccgtagtcgggcctgccgtcggccnccctaagtcggtcgacgaccgacgaacggccgggacccacggacccgtggacgtccgtacgacggttacggggaacgtaccgacgtaccgaccgtaccgacggtacccgtcgggaccggtacggtccggtaggggtccgggggtaaccgtaaccggggacccgtaccgggaccccgtaaaccggggtccccgttccccgggttcccccgttccgggtccccgtaccgttccccggttcccggttccccccgttaccccgttccccgttaacccgtaacccggg

SEQ ID NO: 392567 - DNA, 634 bp, Homo sapiens
  misc_feature: GZ8MTXP01BKT0N.19.80.H03.1.454.CMB.2.raw
  modified_base (219)..(219): a, c, t, g, unknown or other
  modified_base (509)..(509): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgaggancccatgctgcaaggtcgggccagaggtcgcccctgaacctgaacggccaaatgacgacccaagacaggaccaaggtggttgtgacgacccctggagagcgtcgggcccctggccccaggcagcgcgtcgccctgctgctgccgtggggtctcggacctagtccgggtccgcccgagtcgggcctcgccgtcgccgaccctagttcggtcgccgaccggacgaaacgggcccgggaacccacggacccgtagggacgctacgacgggttacgggaaacgcgaacgccgtancccgacgccgtcggccggacggtccgtcgggtgggcgtacgggttcgaacggcccgaagggtcccttccggcccccgttcggtcctcctccgttcccgtccccttacccgtccttcccgtaacgg

SEQ ID NO: 392568 - DNA, 730 bp, Homo sapiens
  misc_feature: GZ8MTXP01BTMLI.19.80.H03.1.454.CMB.2.raw
  modified_base (168)..(168): a, c, t, g, unknown or other
  modified_base (221)..(221): a, c, t, g, unknown or other
  modified_base (247)..(247): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggancccatgctgcaagtcgggccagagtnccctgaacctgaaggccaaatgagaccaagacaggccaagtgggttgtgagacccctgaggagcgtgggccctggtcccaggcagcgcgtcggcccctgctgctggcctgggtctggcccagtcgggtccgcgtcacgtggccctgccgtcggacccgcccctaaagtcgggttacgaccgaacccggacgaaaacgggcccgggggaacccacggaaccccgtcgggaacgcccgttaccgtagggggtttacgggaaacggaccgaacggtaccccgtaacgtccccggaacggccccgttcggtaccccgggggtaacggccccgggtaaggggttcggggggaccgttacggggtacccgaacgggtacccccgaaacgggggttccccttccccgggttacccccccggttccgggtaaccctccctttcccgggttccccgttaccccccgtaacccccgtttccccgtaaccccgg

SEQ ID NO: 392569 - DNA, 617 bp, Homo sapiens
  misc_feature: GZ8MTXP01AVKUS.19.80.H03.1.454.CMB.2.raw
  modified_base (221)..(221): a, c, t, g, unknown or other
  modified_base (374)..(374): a, c, t, g, unknown or other
  modified_base (380)..(380): a, c, t, g, unknown or other
  modified_base (388)..(388): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaaggtcggccagaggtcgcccctgaacctgaacggccaaagtgacgacccaagacaggaccaaggtgggttgtgacgacccctggaggagcgtcggggccctggtcccaggcaggcgctcggcccctgctgctgccgtggtcnggcccngtcggtcnccgagtcgcctgctcgcgtacccgagtcggtcgcgaccgacgaacggccgggacccacgacccgtcgacgcctgaggttcgggaagcgacgcccgatcccgacgtccgacgccgggacgtccggtgggtcgggcgacggttcgaccggacccgacggtcccttcccggccccgttaccgggtcctcccgttcccgtcccgttcccccgccccttcccgcccgtaaccgg

SEQ ID NO: 392570 - DNA, 671 bp, Homo sapiens
  misc_feature: GZ8MTXP01EIZTI.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctcgagggagcccatgctgcaaggtcgggccaggaggtcgcccctagaaccctggaacggccaaatgacgacccaagacaggcaagtggtgtgacgaccccgtgaggagcgtgggccctggtcccgaggcaggcgcgtcggcccctgctgctggtcccgtgggtctggccagtcggtccgcccagtcggccctgcctcggccgacctagtcggtcgccgaacgacgaaacggacccggggaaccccacgggacccgtagggacgccgtacgtacggttaggggaacgcgaccgccgacgtcccgacgccgtagggccggtacggtccggtcggggtcggggaacgtacgggttccaacgggccccgtaacgggtcccgttccccggttcccccgttcgggtccctacccgttcccgttcccggtccccccgttacccttccccgttaacccgtaaccggg

SEQ ID NO: 392571 - DNA, 614 bp, Homo sapiens
  misc_feature: GZ8MTXP01A3XKZ.19.80.H03.1.454.CMB.2.raw
  modified_base (223)..(223): a, c, t, g, unknown or other
  modified_base (391)..(391): a, c, t, g, unknown or other
  modified_base (502)..(502): a, c, t, g, unknown or other
  modified_base (523)..(523): a, c, t, g, unknown or other
  modified_base (548)..(548): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccaggggccaccgtcctccagggacncccatgctgcaaggtcgggccaggacggtcgccccctagaacctggaacggccaaatgaacgacccaagacaggccaaggtgggttgtgacgaccccgtggaggagcgtgggccctggcccaggcagcgctcggccctgctgctgccgtgggtctggccagtcggccncccgatcgcctgctcgcgcccagtgtcgcgaccgacgaacggcccgggacccacggacccgtagggactcccgtagacggttggggaacgcgacgccgatcccgagtccgngcggtcgccgtggcggggccnggttccgaccggccaacgggtcccnccggttccccgttcggtaacctcccgttccctcccggtacccccttcccctcccgttccgaaccgg

SEQ ID NO: 392572 - DNA, 657 bp, Homo sapiens
  misc_feature: GZ8MTXP01CCP3S.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaacggccaatgacgaccaagacaggccaagtgggtgtgacgacccctggaggagcgtgggccctggtcccaggcagcgctggcccctgctgctggccctggggtctggcctagtcgggtccgcccgagtcgggcccttgcctcggccgccctaagttcggttcggccgaccggacgaaacggacccgggggaaccccacggaccccgtcgggacgtcccgtacgtacggttacgggggaacgcgacgccgactcccgacggcctgggccgaggtccgtcggtcggggcgtacgggttccgaacggcccgaaacgggtccgttacccggttcccccgttcgggtccctacccgttccgttcccggttcccccggcccttccccgttccggtaacccggg

SEQ ID NO: 392573 - DNA, 603 bp, Homo sapiens
  misc_feature: GZ8MTXP01CMU89.19.80.H03.1.454.CMB.2.raw
  modified_base (408)..(408): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaaggtcgggccagaggtcgcccctgaacctgaacggccaatgagacccaagacaggccaagtgggttgtgagacccctgaggagcgtcgggccctggtccccaggcagcgctggccctgctgctgcctgggtctggccagtcgtccgcccagtcgggcctgctgccgccatggtcncgacgcgaaacggcgggacccacgacccgtggacgccgtacgaggttaggggaacgcgacgccgtactcccgacgccgtacggcggacgtcccgtgggtcggggctacgggcgacgcccgaacggccttacccggccccgttcgggtcctaccgttcctcccggttccccacccgttcccgttcccgtaaccggg

SEQ ID NO: 392574 - DNA, 644 bp, Homo sapiens
  misc_feature: GZ8MTXP01E0YH3.19.80.H03.1.454.CMB.2.raw
  modified_base (223)..(223): a, c, t, g, unknown or other
  modified_base (473)..(473): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccagggcaccgtcctccgagggacncccatgctgcaacggtcgggccaggacggtcgccccctgaacctgaaacggccaaatgacgacccaagacaggccaaggtggtgtgacgacccctggaggagcgtcgggccctgggtcccaggcacggccgcgtcggcccctgcctggctggcccgtggggtctacggcctagtcggtccgccctagtcgggcctgcgtcgcgacccagtcggtcgcgacgacgaaacggccgggaccacgaccgtgacnctgagtcggggaagcacgccgatccgacgccgtcggcggacgtcgtcgggtcggggcgtcggacgaccggacccgacgggtcccttacccgggttcccccgttcgggtaacccctccgttccccgttcccggttcccccggttccccttaacccggaaccccgtaaccggg

SEQ ID NO: 392575 - DNA, 643 bp, Homo sapiens
  misc_feature: GZ8MTXP01DIFGL.19.80.H03.1.454.CMB.2.raw
  modified_base (246)..(246): a, c, t, g, unknown or other
  modified_base (256)..(256): a, c, t, g, unknown or other
  modified_base (262)..(262): a, c, t, g, unknown or other
  modified_base (272)..(272): a, c, t, g, unknown or other
  modified_base (282)..(282): a, c, t, g, unknown or other
  modified_base (287)..(287): a, c, t, g, unknown or other
  modified_base (290)..(290): a, c, t, g, unknown or other
  modified_base (294)..(294): a, c, t, g, unknown or other
  modified_base (312)..(312): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtnccctgaaccngagcangacacagacngcaggtggtnagacnccngagngcgtcgcctgcccgagcngccgcgtccgcctgctgctcgccgtcggtcgtcgcctaggtccggcccgccgtagccggtcccgtcgtccgtcggcccgtacctaggttcgtacgaccgaccgacgaacgggcccgggaccacggcccgtgacgccgtagtacggttacggggaacgcgaacgcccgtacgccgacgtccggtaacggccgggtgtccggttaggggcgggaaccgtcgggttaaccgccggaaccggaccgggtccccttcccgggttcccccgttcgggtaaccttcccgttcccgtttccccggttcccccgccctttaacccggttaacccgtaagg

SEQ ID NO: 392576 - DNA, 677 bp, Homo sapiens
  misc_feature: GZ8MTXP01BUQDI.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggancccatgctgcaagtcgggccagaggtcgcccctgaacctgaacggccaatgagacccaagacaggccaagtgggttgtgagacccctgaggagctggggccctggtcccaggcagcgctcggcccctgctcgctgccgtgggtctggccagtcgggtccgcccgatcgggccctggctcggccgtccccgaagttcggttacgcccgaccgaccgaaacggccgggggaccccaggaccccgtgggacgccgtcgtaggttcggggaacgccgaagcccgacgtcccgacgtcccgtacgggccggtacggtcccggtcgggtcgggggccgtacgggttacccgacgggaccccggaacgggtcccgttccccgggttccccccgttccgggtaacccctcccgttcccgttccccgtttccccccgggccccttccccgttcccgtaacccggg

SEQ ID NO: 392577 - DNA, 685 bp, Homo sapiens
  misc_feature: GZ8MTXP01DTQ6X.19.80.H03.1.454.CMB.2.raw
  modified_base (218)..(218): a, c, t, g, unknown or other
tcagtactctcgtgcacgaccggtgctcgatttagctgtgcgtcgaagggaaaggggccctctgggagagatccccagggtgacagccatggaccctggaagggcctgggctagggacagggaccagagccagtccagggagaggacagagccaatggactggggtgtactgtaacagccctgctggcgagaggaccagggcaccgtcctccagggancccatgctgcaagtcggccagaggtgccctgaacctgaaggccaatgagaccaagacaggccaagtggttgtgagacccctgaggagctggggccctggtccccaggcagcgctcggcccctgctgctgcctgggtctggcccagtcgggtccgccctagtcgggccctggtcctcggccgtaccccaagtcgggttcgccgaaccggcgaaaacgcccgggggaaccccacggaccccgtgggaacgcccgttacgacggtttacgggggaacgtaccggaacgcccgagtccccgacgccccgttgggccggtacggcccgtggggtcgggggccgtaaggggttcccgaacggaccccgaaacgggtccccttacccgggttcccccccgttcggggttcccctaccgtttccccgttcccggttccccccaccccgtttcccccttaaccccgtaaacccggg

SEQ ID NO: 392578 - DNA, 667 bp, Homo sapiens
  misc_feature: GZ8MTXP01DI57Z.19.80.H03.1.454.CMB.2.raw
  modified_base (222)..(222): a, c, t, g, unknown or other
  modified_base (427)..(427): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcgggccaggaggtcgcccctagaacctgaaacggccaaatgacgaccaagacaggcaaggtggtgtgacgacccctggaggagcgtcgggcccctggtccccgaggcagcgctcggcccctgctgctgcccgtgggtctggccagtcggtcgcccgagtcgggcctgcctcgccgacccgagttcggtcnccgaccgacgaaacgggccggggacccacgacccgtggacgccgtacgaggttacggggaacgcgaacggccgaacgtcccgacgcccgtaggccggtacgtcccggtgggtcgggggaacgtacgggttaccgaccggccccgaacgggtcccgttacccgggcccccgttcgggtcccctacccgttcccgtttacccgttacccccttaccccgttccccgttaacccgtaacccgg

SEQ ID NO: 392579 - DNA, 781 bp, Homo sapiens
  misc_feature: GZ8MTXP01A7T54.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgaggancccatgctgcaagtcggcagagtgccctgaacctgaagccaatgagaccaagacaggccaagtgggttgtgagacccctgaggagctgggccctggtcccaggcagcgctggccctgctgctgccgtgggtctggccagtcggtccgcccgatcgggcccttgccgttcggcccgtaccccgtaaagtcgggtttacggaccgtaacccgggaccgaaaaacgggcccggggggaaacccccctaacgggaaccccccgttaggggaaccggtaccccgttaaccggtaacggtttacggggggaaacggtacccggaacggaccccggtaaacgtcccccgaaacgggccccgttaacgggccggggtaaaccggcccggtttacggggtcggggggtaacccgaaacgggggtttccccgaaaccgggacccccggtaaaacggggcccgttccccgggttcccccccggttacccggggttcccctaaccccggtttcccgtttccccggggtttacccccccggcccccttttccccgccccgttaaaaccccgggg

SEQ ID NO: 392580 - DNA, 637 bp, Homo sapiens
  misc_feature: GZ8MTXP01DNBD6.19.80.H03.1.454.CMB.2.raw
  modified_base (222)..(222): a, c, t, g, unknown or other
  modified_base (250)..(250): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggancccatgctgcaagtcgggccagaggtcnccctgaacctgaaggccaaatgacgaccaagacaggcaagtgggttgtgacgacccctgaggagcgtcggggccctggtccccgaggcagcgcgtcggcccctgcctgctgcctgggtctggcctagtcgggtccgcccagtcgggcctgcgtacgccgcccagtcggttcgaccgaccgcgaaaacggcccggggaacccacggaccccgtaggacgccgtacgacggttacgggggaacgcgacgacccgaagccccgacgcccgtcgggccggtacgcccggtgggtcgggaacgtgggccacggacccgaacggcccgttccgcccccgttcggtccctaccgttcccgtcggttcccccgcccctcccgttccgtaacccgg

SEQ ID NO: 392581 - DNA, 570 bp, Homo sapiens
  misc_feature: GZ8MTXP01DWH2O.19.80.H03.1.454.CMB.2.raw
  modified_base (385)..(385): a, c, t, g, unknown or other
  modified_base (413)..(413): a, c, t, g, unknown or other
  modified_base (443)..(443): a, c, t, g, unknown or other
  modified_base (489)..(489): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtcgcccctgaacctgaacggccaaatgagacccaagacaggccaagtgggttgtgacgacccctggaggagcgtcggggccctggtccccaggcagcgcgtcggcccctgctgctgccgtgggtctggccagtcggtcncccgatcgggcctgctcgcgccatggtncacgcaaacggccgggaccagccctggacncctacgaggttggggaaacgcgacgccgaactccgagcctggcggngccgtggcgggcaggttcgacgccgaaggccttccgccccttggtccactcctccgtccccacccgtccgttccgaaccgg

SEQ ID NO: 392582 - DNA, 691 bp, Homo sapiens
  misc_feature: GZ8MTXP01ES60C.19.80.H03.1.454.CMB.2.raw
  modified_base (220)..(220): a, c, t, g, unknown or other
  modified_base (245)..(245): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggcagaggtncccctgaacctgaagccaatgagacccaagacaggccaagtgggttgtgagacccctgaggagcgtggggccctggtccccgaggcagcgccgtcggcccctgctgctgccgtgggtctaggccagtcgggtccgcccgagtcgggccctgctcggccgccctaagtcggttcgcgaccgaccgaaacggacccgggggacccacggaccccgtagggaccgccgtacgtagggttacggggaacgcgacggcccgaacgttccccgacggtcccgtcgggcgggaaccggtccggtcggggtcgggggccgtaacggggttccgaccgggaccccgaaacggggtccccgttcccgggttcccccccgttcggggtcccctaacccgtttcccgttccccggtttcccccaacccccgttccccgtttccccggtaaaccccggg

SEQ ID NO: 392583 - DNA, 650 bp, Homo sapiens
  misc_feature: GZ8MTXP01EIVWL.19.80.H03.1.454.CMB.2.raw
  modified_base (168)..(168): a, c, t, g, unknown or other
  modified_base (223)..(223): a, c, t, g, unknown or other
  modified_base (243)..(243): a, c, t, g, unknown or other
  modified_base (246)..(246): a, c, t, g, unknown or other
  modified_base (262)..(262): a, c, t, g, unknown or other
  modified_base (265)..(265): a, c, t, g, unknown or other
  modified_base (284)..(284): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacnccatgctgcaagtcggcagngtnccctgactgacgcaanganaccagacagcaagtggtgngagaccctgaggagcgtgggccctggtcccaggcagcgctcggcccctgctgctggcctgggtctaggccagtcggtccgcccgattcgggccctgccgtcggccgtacccaagttcggtcgaccgaccggacgaaacgggcccggggaaccctacggaccccgtggaccgccgtacgacggttggggaaacggcgaacggcccgaatcccgacgccgtcggccggacggcccgttggcgggggcaacgggttccgacggttaccccgaacgggtcccttacccgggttccccccgttcgggttcccctccgttccccgttcccggttaccccccttaccccgttccccgttcccgtaaacccggg

SEQ ID NO: 392584 - DNA, 627 bp, Homo sapiens
  misc_feature: GZ8MTXP01BYXZ6.19.80.H03.1.454.CMB.2.raw
  modified_base (220)..(220): a, c, t, g, unknown or other
  modified_base (246)..(246): a, c, t, g, unknown or other
  modified_base (483)..(483): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtnccctgaacctgaaggccaaatgagacccaagacaggccaagtgggtgtgagacccctgaggagcgtggggccctggtccccaggcagcgctggcccctgctgctgcctgggtctggccagtcggtccgcccgatcgggcctgctacgcgccccgaagtcggttcgcaccggcgaaacggccggggacccacgacccgtggacgccttacgagttagggggaacgccgacgccgtaancccgacggcccgtacggcggacgcccggtgggtcgggggcgagggttccacggcccgaacgggcccgttccggttcccccgttacggttcccgaccgttcccgttccggttcccccggccccttccccgttcccgtaacccggg

SEQ ID NO: 392585 - DNA, 607 bp, Homo sapiens
  misc_feature: GZ8MTXP01DXZ4Y.19.80.H03.1.454.CMB.2.raw
  modified_base (223)..(223): a, c, t, g, unknown or other
  modified_base (270)..(270): a, c, t, g, unknown or other
  modified_base (299)..(299): a, c, t, g, unknown or other
  modified_base (314)..(314): a, c, t, g, unknown or other
  modified_base (369)..(369): a, c, t, g, unknown or other
  modified_base (383)..(383): a, c, t, g, unknown or other
  modified_base (452)..(452): a, c, t, g, unknown or other
  modified_base (569)..(569): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggacgtggggtgtactgtaacagccctgctggcgagagggaccagggccaccgtcctcgagggacncccatgctgcaagtcggcagacgtcgccctgaacctgaacgccaaangaacgaccaagacaggacaaggtggttgngacgaccctggaggngcgtcgggccctggcccaggcagcgccgtcggcccctgctgcgtgccgtgggtcncggcagtccggccnccgagtcggcctgccgtcgccgtcctagtcggtcaccgacgacgaaacggccgggacccacgtacccgngcgccgtagaggttacggggaacgcgacgaccgactccgacgccgtacggcggtacgccggtggcggggcgtacgggcgaccggccgaacggccgttcccgttccccgttcggtccnccgtcccttcccgtccccacccgttcccgccgtaacgg

SEQ ID NO: 392586 - DNA, 654 bp, Homo sapiens
  misc_feature: GZ8MTXP01BOEIC.19.80.H03.1.454.CMB.2.raw
  modified_base (220)..(220): a, c, t, g, unknown or other
  modified_base (246)..(246): a, c, t, g, unknown or other
  modified_base (521)..(521): a, c, t, g, unknown or other
  modified_base (611)..(611): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtnccctgacctgaaggccaatgagacccaagacaggccaagtggttgtgacgacccgtgaggagcgtcgggccctggtcccgaggcaggtcgcgtcggcccctggctcgctggtccgtgggtcgtcggccgagtcgggtcccgcccgtagtcgggcctcggcgttcggccgtaccctacggttcggttcgaccggaccggaacgaaaccgggacccggggtaacccacggaccccggtggaccgcgtacgacggttaggggacgcgacgaccgtacnccgacgccgtggaccggcggtccggtggggtcggggcgtacgggttcgaccgaccggacgtcccggttacccgccccggttcggttcccnccgttccgttccccgtcccgcccttcccgttaacccggaaccg

SEQ ID NO: 392587 - DNA, 729 bp, Homo sapiens
  misc_feature: GZ8MTXP01C45B4.19.80.H03.1.454.CMB.2.raw
  modified_base (221)..(221): a, c, t, g, unknown or other
  modified_base (535)..(535): a, c, t, g, unknown or other
tcagtactctcgtggcacgaccggtgctcgatttagctgtgcgtcgaagggaaaggggccctctgggagagatccccaggggtgacagccatggaccctggaagggcctgggctaggggacagggaccagagccagtccagggagaggacagagccaatggactggggtgtactgtaacagcctgctggcgagagggaccagggcaccgtcctcgagggancccatgctgcaaggtcgggccagaggtcgccctgaacctgaacggccaatcgacgaccaagacagcgaaggtggttgagacgacccgtggacggagccggtcggggtcccctgggtcccccaagggccgacggccggtccgtccgggccccctggtcctcggcttcgggcccgttaggggtcctcgggccgtacggtcccgggtccgtcccgagtttcccggggccttacggccgtcgacccgtcccgtaagttcgggtcgacgaccggacggtaaaccggggcccggggtaacccacgggacccgtggaaccnccgtacggtacggtacggggaacgccggtaagcccgaactccgacgccgtacggccggtcggcccggttgggcggggaacctaggggaccgacccgacccggtaaggtcccgttacccgggttcccccttacgggttaaccctacccggtccctttaccccgtccccttacccccgttcgaacccggtaaccgg

SEQ ID NO: 392588 - DNA, 641 bp, Homo sapiens
  misc_feature: GZ8MTXP01DHYZY.19.80.H03.1.454.CMB.2.raw
  modified_base (400)..(400): a, c, t, g, unknown or other
  modified_base (413)..(413): a, c, t, g, unknown or other
  modified_base (417)..(417): a, c, t, g, unknown or other
  modified_base (430)..(430): a, c, t, g, unknown or other
tcagtactctcgtgcacgaccggtgctcgatttagctgtgcgtcgaagggaaaggggccctctgggagagatccccgaggggtgacagccatggaccctggaagggcctgggctagggacagggaccagagccagtccagggagaggacagagccaatggacgtggggtgtactgtaacagccctgctggcgaggagggaccagggccaccgtcctccgagggacgcccatgctgacaaggtccgggaccaggaggtcgaccccgtaggaacctggaaacggccaaagtgaacgaacccaagacaggcctaaggtgggttgcgacgaccccgtggaggagccgtcgggcccctggccccgaggcacggccgcgtcggcccctgcctgctgccgtgggtcnggccagtccggcnccgngtcgctgctcgcnccagtgtcgcgacgacgaacggacgggacccacggaccgtggacgaccgtacgtacggtacggggaacgcgtacggaccgacgtcccgcgccgtcggccgggtacgtcggtgggtcgggcgtacggccgtacgccgtaacggccgttcccgccccgttcggtccctacgttcccgtccccgttcccaccccttcccgttaaccgtaaccgg

SEQ ID NO: 392589 - DNA, 697 bp, Homo sapiens
  misc_feature: GZ8MTXP01EKAVA.19.80.H03.1.454.CMB.2.raw
  modified_base (168)..(168): a, c, t, g, unknown or other
  modified_base (220)..(220): a, c, t, g, unknown or other
  modified_base (245)..(245): a, c, t, g, unknown or other
  modified_base (378)..(378): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcgagggancccatgctgcaagtcggccagagtnccctgaacctgaacggccaatgagaaccaagacaggccaaggtgggttgtgacgacccctggaggagcgtgggccctggtcccaggcagcgcgtcggccctgctgctgccgtgggtctggcctagtcggtccnccgagtcggccgtcgcgtcggccgtccctaagtcggttcgacgaccgacgaacggaccggggaaccctacggacccgtaggaccgccgtacgtacggttacgggggaacgccgtacggaccgttacgtcccgaacggtccgtacgggaccgggacggtccggtcggggttcgggggtaacaacgggggtttccgaacccgggttacccgaaaccggggtcccgttaccccgggttcccccgttaaccgggttcccgtaccgttcccgtttcccggttacccccttaccccgttccccgtttaaccccggtaaacccggg

SEQ ID NO: 392590 - DNA, 645 bp, Homo sapiens
  misc_feature: GZ8MTXP01EVEKV.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtcgccctgaacctgaaggccaaatgagacccaagacaggccaagtgggttgtgagacccctgaggagctggggccctggtcccaggcagcgctcggcccctgctgctggcctgggtctggccagtcggtccgcccatcgggccctgcctcgccgcccctaagtcggttgccgaccgacgaaacggccggggaccccacggaccccgtggaccgcctacgtacggttacgggggaacgtccgaacggcccgactcccgacgccgtacgggcgggacgtccgtgggtcggggcgtacgggttccaccggaccccggaaagggtcccttccggccccccgttccggggtcccacccgttcccgttcccgttacccccgacccctcccccgaaccggtaacccgg

SEQ ID NO: 392591 - DNA, 603 bp, Homo sapiens
  misc_feature: GZ8MTXP01BK7GS.19.80.H03.1.454.CMB.2.raw
  modified_base (248)..(248): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcgggccagaggtnccctgaacctgaaggccaaatgacgacccaagacaggccaaggtggtgtgacgaccccgtgaggagcgtcgggccctggtcccgaggcagcgctcggccctgctgctgccgtcggtcaggccagtcgtccgcccagtcgggcctcggcgtcgcgtcccaagttcggtcgacgacgacgaaggaccgggaccacgacccgtggaacgcctacgaggttcggggaacgcgaacgccgatcccgagccgtaggcgagcgtacggtggggctacggttcgacgcccgtaagggcccttccgggttccccgttcggtccctacgtccgttccgtccccgttccctcccgttcgaacccgg

SEQ ID NO: 392592 - DNA, 693 bp, Homo sapiens
  misc_feature: GZ8MTXP01B3F78.19.80.H03.1.454.CMB.2.raw
  modified_base (168)..(168): a, c, t, g, unknown or other
  modified_base (317)..(317): a, c, t, g, unknown or other
  modified_base (384)..(384): a, c, t, g, unknown or other
  modified_base (497)..(497): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggcgcccatgctgcaaggtcgggccaggagtcgcccctgaacctgaacggccaatgacaccaagacaggcaaggtggtgtacgacgaccccgtgacggngcgtcggccctcggtcccaggcagcgctcggccctgctgctgcctcgggctcggccagtcgggtccncccgtagtcggcccttgccgttcgccgacccgtaagtcggttccgccgaaccgacgaaaccgggcccgggaacccacggaccccgtggacgcccgtagacggttcggggaacnccgacgcccgtaagtcccgacgcccgtagggccggtacgtcccggtggggtcggggtaacgtaccgggttaccgaccggttacccgtaaacgggccccgttacccgggttccccccttaccgggttaaccccgtaccttccccggtttaccccgtccccccgttaacccgttcccccggttaacctaaccccgggg

SEQ ID NO: 392593 - DNA, 696 bp, Homo sapiens
  misc_feature: GZ8MTXP01DD3GL.19.80.H03.1.454.CMB.2.raw
  modified_base (168)..(168): a, c, t, g, unknown or other
  modified_base (222)..(222): a, c, t, g, unknown or other
  modified_base (397)..(397): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaagtcgggccagaggtcgcccctgaacctgaaggccaaatgacgaccaagacaggccaaggtgggttgtagacgacccctggaggagcgtcggggcccctgggtccccaggccaggcgcgtcggcccctgccttgctggccgtgggtctggccctagtcggtccnccgagtcggcctgctcgccgacctagtcggtcgacgaccgcgaaacggcgggacccacggacccgtggaacgtccgtacgacggttaggggaacgcgaacgcccgacgtcccgaggcccgtcgggcccggtacggtccggtcgggtcgggggtccgacggggttccgaacccgggaccccggaaacggggtccccgttccccgggttccccccgttccgggtaaccccgtacccgtttccccggtttcccggttccccccggttaccccgtttccccgttaaccccgttaaacccgggg

SEQ ID NO: 392594 - DNA, 661 bp, Homo sapiens
  misc_feature: GZ8MTXP01AZ01S.19.80.H03.1.454.CMB.2.raw
  modified_base (385)..(385): a, c, t, g, unknown or other
tcagtactctcgtgcacgaccggtgctcgatttagctgtgcgtcgaatggaaaggggccctctgggagagatccccaggggtgacagccatggaccctggaagggcctgggctagggacagggaccagagccagtccagggagaggacagagccaatggacaggggtgtactgtaacagccctgctggcgagagggaccagggcaccgtcctccgagggagcccatgctgcaagtcggccagaggtcgccctgaacctgaacggccaatcgaacgacccaagacaggaccaaggtgggtgtaggacgaccccgtggacggaggccgtcgggccccgtgggtccccaagggccacggcgcgtcggcccctgctgctcgcgtggtcnggccaagtcggcgccgagtcggcctgctcgccgtccgtagtggtcgccgaccggacgaaacgggccgggaccacggacccgtgacgaccgtcgaggggttacggaacgacgacggaccgactccgaacgccggtacggccggggtacgccgggttcggggaacggggaccgttacggggtaccgaccgggacccggtaacggttccccgttccgcccccggttaacggtcccgaaccgtttccggtcccgttccccgccccgttccgtaaccccgg

SEQ ID NO: 392595 - DNA, 702 bp, Homo sapiens
  misc_feature: GZ8MTXP01D5CAW.19.80.H03.1.454.CMB.2.raw
  modified_base (218)..(218): a, c, t, g, unknown or other
  modified_base (246)..(246): a, c, t, g, unknown or other
  modified_base (337)..(337): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctcaggganccatgctgcaagtcgggccagacggtcncccctagaacctgaacggccaatgaacgacccaagacaggccaaggtgggttgtagacgacccctggaggagcgtcgggccctggtccccnggcagcgctcggcccctgctgctgccgtgggtctggcctagtcggccgcctacgtcgggccctgactcggaccgtacccgtagttcggttcgccgaccgacggaaacgggacccggggacccacggacccgtacggaccgcctacgtacggttacggggaacgcgacggacccgactacccgacgtccgtacgggccggtacggcccggttggggtcgggggccttaacggggttccggaaaccgggttccccggaaacgggtccccgttccccgggttccccccgttaccgggggtcccttaccccgtttcccggtccccggttcccccgttacccccgttcccgttaacccggtaaacccggg

SEQ ID NO: 392596 - DNA, 700 bp, Homo sapiens
  misc_feature: GZ8MTXP01CBCL8.19.80.H03.1.454.CMB.2.raw
  modified_base (222)..(222): a, c, t, g, unknown or other
  modified_base (252)..(252): a, c, t, g, unknown or other
  modified_base (403)..(403): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggancccatgctgcaaggtcgggccaggaggtcncccctgaacctgaacggccaaagtgacgacccaagacaggcaaggtggtgagacgacccctggaggagccgtcggggcccctggtccccgaggcacggccgcgtcggcccctgcctggctgcccgtgggtactcggcctacgtcgggtccncccgtagttccgggccctcggacctcgggaccgtacccgtaacggttcggttacgaccgaaccggaccgaaacgggacccggggaccccgaacggaccccgtacggaccgtccgtacgtaacggttacggggaacgaccgaccgaccgtacgcccgacgccggtacggccggacggtccggtcgggtcggggaacgtcgggccgaccgccggaacggtccgttacccgttccccgttacggtcccgtaccgttccgttccccgttccccttaccccgtcccgttaacccgtaaccgg

SEQ ID NO: 392597 - DNA, 661 bp, Homo sapiens
  misc_feature: GZ8MTXP01DQAP4.19.80.H03.1.454.CMB.2.raw
  modified_base (223)..(223): a, c, t, g, unknown or other
  modified_base (386)..(386): a, c, t, g, unknown or other
  modified_base (456)..(456): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgaggggacncccatgctgcaagtcgggcagaggtcgcccctgaacctgaaggccaaatgacgacccaagacaggccaaggtgggttgtagacgaccccgtggaggagcgtcgggccctggcccaggcagccgctcggcccctgctgctgccgtggctggcctagtcggtccnccctagtcggcctgccgtcgccgtcctagtcggtcgcgaccgacgaaacgggccgggacccacgacccgnggacgcctacgacggttacggggaacgcgtacgccgacgtcccgacgccgtagggccggtaccggtccggtcgggtcgggggaaccgtacgggttaccgacgggaccccgaacgggtcccttcccgggttcccccgttccgggttcctaccccgttcccgttccccggttcccccggttccccttcccgttccccggtaacccgg

SEQ ID NO: 392598 - DNA, 623 bp, Homo sapiens
  misc_feature: GZ8MTXP01CT2XH.19.80.H03.1.454.CMB.2.raw
  modified_base (221)..(221): a, c, t, g, unknown or other
  modified_base (246)..(246): a, c, t, g, unknown or other
  modified_base (265)..(265): a, c, t, g, unknown or other
  modified_base (287)..(287): a, c, t, g, unknown or other
  modified_base (367)..(367): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcggcaggagtnccctgaacctgaagccaangagaccagacagcaagtggtgngagaccctgagagcgtgggccctggcccgaggcagcgcgtcggccctgctgctgccgtgggtctggcctagtcgggtccnccgagtcggcctgccgtcggcgacccgtaagttcggtacgaccgaccgacgaaaacggccggggaaccccaggaccccgtaggaccgtcgtacgacggttaggggaacgcgacgccgactccgagccgtagcgtagtcgagggtcggggccagggttaccacggcccgaacgggtcccgttacccggcccccgttacgggtccctaccgttcccgtcccggttcccccgccccgttaaccccgttccgtaacccgg

SEQ ID NO: 392599 - DNA, 680 bp, Homo sapiens
  misc_feature: GZ8MTXP01CMEYJ.19.80.H03.1.454.CMB.2.raw
  modified_base (219)..(219): a, c, t, g, unknown or other
  modified_base (244)..(244): a, c, t, g, unknown or other
  modified_base (288)..(288): a, c, t, g, unknown or other
  modified_base (377)..(377): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggancccatgctgcaagtcggcagaggtnccctagaacctgaaggccaatgagaccaagacaggcaagtggtngacgccctgagagcgtcgggccctggtcccaggcacgcgctcggcccctgcctgctggcccgtggggtctcggaccctagtcgggtccncccgtagtccgggcccttcggaccgttccgggacccgtcccgtaacgttcgggttacggacccgtaacccggaaccggaaaaccggggacccggggtaaaccccgaaccgggtaccccgtcgggaacgcccgtaccgtaacggttacgggggaaacggaccgaacgcccggtactcccgacgtccgtacggcggacgtcccgtgggtacgggcgacgggttcgaccggccgtaaacggccgacccgccccgttaccggtcctaccttccgtcccgttcccgcccctcccgttcccgtaaccgg

SEQ ID NO: 392600 - DNA, 619 bp, Homo sapiens
  misc_feature: GZ8MTXP01EMPAS.19.80.H03.1.454.CMB.2.raw
  modified_base (219)..(219): a, c, t, g, unknown or other
  modified_base (263)..(263): a, c, t, g, unknown or other
  modified_base (266)..(266): a, c, t, g, unknown or other
  modified_base (281)..(281): a, c, t, g, unknown or other
  modified_base (286)..(286): a, c, t, g, unknown or other
  modified_base (361)..(361): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggancccatgctgcaagtcggcagagtgccctgaacctgaagccaaanganaccaagacagcaagnggttngagaccctgaggagctgggccctggtcccaggcagcgctggcccctgctgctgcctggtctggcccagtcggtcncccatcgggcctgctgcgtcccaagtcgttgcgaccgcgaaacggaccggggacccagaccccgtggaacgccgttacgaggtttacgggggaaacgccgaagtccccggaacgtcccgacgtccgtacggcgtacgtccgtcgggcgggcgtacgggttccgaaccgacccgtaacggtcccgttcccggttcccccgttacggtccctaccgttcccgttcccgtccccgttccccttccccgttaaccgtaaccg

SEQ ID NO: 392601 - DNA, 758 bp, Homo sapiens
  misc_feature: GZ8MTXP01BCNCZ.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggaggaccagggcaccgtcctccgagggacgcccatgctgcaaggtcgggccaggaggtcgcccctgaacctgaacggccaatgagacccaagacaggccaaggtggtgtgacgacccctgaggagcgtcgggccctggtccccaggcagccgctcggccccctgctgctggcccgtgggtctggccagtcgggtcccgcccgagtcgggcctcgtccgtcgccgtaccctaagttcgggttacgaccgaacccgggaccgaaaccgggacccgggggaacccctacgggaaccccgtcgggaaccgtcccgtacgtaacgggttaccggggaaacggccggtaaccggaccccggtaaacgttccccggaacgtccccgggtcgggaaccgggtcggtccccggttggggttaccgggggccgaaacggggttccgaaccgggacccccggaaacggggtccccttccccggggccccccgttaccggggtcccctacccgtttcccccgtttccccggggttcccccccttcccccgttaaccccgttaaccccggtaacccggg

SEQ ID NO: 392602 - DNA, 712 bp, Homo sapiens
  misc_feature: GZ8MTXP01AVG73.19.80.H03.1.454.CMB.2.raw
  modified_base (168)..(168): a, c, t, g, unknown or other
  modified_base (220)..(220): a, c, t, g, unknown or other
  modified_base (268)..(268): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcgagggancccatgctgcaaggtcggcagaggtcgccctgaacctgaacggccaangacaccaagacagacaagtgggttgagacgaccccgtaggaggacgcgtcggggcccctcggcccgaggcacggcgccgtcggcccctgcctgcgtggcccgtgggtcgtggcctagtcggccgccgtaggtccggccgttcggccgtcggcccgtacccgtaagtcggtcgaccgaccgaacgaaacgggacccgggacccacggacccgtacggaccgtccgtacgtacgggttacgggggaaacgcggaaccgacccgaacgcccgtaccggccggtacggccgggaccggtccgggtcggggtcgggggaacgtacgggttaccggaccggcccggtaaaccggtcccgttaccccggttcccccggttaccggttccccgtacccgttcccgttccccgttacccccgttaccccgttcccgttaaccccggtaaccgg

SEQ ID NO: 392603 - DNA, 704 bp, Homo sapiens
  misc_feature: GZ8MTXP01BGTNY.19.80.H03.1.454.CMB.2.raw
  modified_base (226)..(226): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccaggggccaccgtcctccgaggggacncccatgctgcaaggtcgggccaggaggtcgccctgaacctgaacggccaaatgagacccaagacaggccaagtgggttgtgacgacccctgaggagctggggcccctggtccccaggcaggcgctcggcccctgctgctgccgtgggtctggccagtcgggtccgcccgtagtcgggccctgaccgtcggccgccctaagtcggttcgccgaccgacgaaacggccggggaacccacggaccccgtaggacgtccgtacgtacggttacgggggaacgccgaaccggccgaactcccgaacggtcccgtacgggccgggtaacgccggttcggggtcgggggccgtaaggggttcccgaaaccggccccggaaacgggtccccggttacccgggttccccccgttacggggtcccctaaccgttcccggtttccccggttcccccgttccccgttccccgttccccgtaaacccgggg

SEQ ID NO: 392604 - DNA, 650 bp, Homo sapiens
  misc_feature: GZ8MTXP01EBTOA.19.80.H03.1.454.CMB.2.raw
  modified_base (219)..(219): a, c, t, g, unknown or other
  modified_base (246)..(246): a, c, t, g, unknown or other
  modified_base (506)..(506): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggancccatgctgcaagtcgggccagaggtnccctgaacctgaagccaatgagaccaagacaggccaagtggttgtagacgaccctggaaggagcgtcggggccctgggtccccaggcaggcgctcggcccctgctgctgcctgggtctggccctgtcggtcgcccgagtcgggccctggccgtcgaccgtacccgtaacgtggttcgacgaccggacgaaacggaccggggaccctaggaccccgtggacgcccttagacggttacggggaagaccgacgccggtaaccncccgacgtccgtacggccggtacggtccggtcggggtcgggaaccgtacgggacgacccggacccggaacggtcccgttcccggccccgttcgtcccgtaccgtcccgttccccgtccccgttaccctcccgttaaccgtaacg

SEQ ID NO: 392605 - DNA, 699 bp, Homo sapiens
  misc_feature: GZ8MTXP01CBZ0I.19.80.H03.1.454.CMB.2.raw
  modified_base (219)..(219): a, c, t, g, unknown or other
  modified_base (246)..(246): a, c, t, g, unknown or other
  modified_base (268)..(268): a, c, t, g, unknown or other
  modified_base (382)..(382): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccgagganccatgctgcaaggtcgggccagaggtncccctgaacctgaaggccaaangacgaccaagacaggccaaggtgggtatgacgacccctgagagcgtgggcccctggccccaggcacgcgactcggccctgctgctggcccgtgggtctggccatcgggtacccnccgagtcggcctgcgtcggaccaccctaagttcggtcgaccgaaccggaaccggaaaaccgggacccggggtaaccccgaacgaccccggtaggaaccgtccgtacgtaacgggttacggggaacggacgaccggaccgtaacgtcccgaccgtccgtacggccggtacggtaccggtcgggtcggggtcgggtacggttacgtaacccgacccggtaaaccggtacccggttcccggttcccccgttcccggtaacccgtacccgttcccgttacccgttaccccgttaccccttaaccccgttaacccgtaaccg

SEQ ID NO: 392606 - DNA, 613 bp, Homo sapiens
  misc_feature: GZ8MTXP01CNL6G.19.80.H03.1.454.CMB.2.raw
  modified_base (219)..(219): a, c, t, g, unknown or other
  modified_base (250)..(250): a, c, t, g, unknown or other
  modified_base (304)..(304): a, c, t, g, unknown or other
  modified_base (360)..(360): a, c, t, g, unknown or other
  modified_base (482)..(482): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccaggcaccgtcctccgaggcncccatgctgcaaggtccggaccaggaggtcncccctagaacctgaacggccaaagtgacgacccaagacaggccaaggtggttgngacgacccctggaggagctgggcccctggtccccaggcagcgcgtcgccctgctgntgctggtctggccagtcgtcgcccgagtcgcctgcgcgccgacccagttcggtacgccgaacgacgaaacggccgggaacccacgacccgtggacgcccgttacgagttacggggagaccgngaccgatccgacgccgtggaccgcgtccgtgggtcggcgacggcgaacgccgtaaacggcccttacccgccccggttcgtaacctcctccggttcctccccgttaacccttccccgttaaccgtaacccgg

SEQ ID NO: 392607 - DNA, 561 bp, Homo sapiens
  misc_feature: GZ8MTXP02HP04X.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgccctgaacctgaaggccaatgagacccaagacaggccaaagtgggttgtgagacccctgaggagctgggccctggtcccaggcagcgctggccctgctgctgcctgggtctggccagtcggtcgccccatcgggcctgctgcgcccaatggttcgcaccgcaaagccggggacccaggacccctgggacgccctacgaggtttggaaacgcaggcccgaatcccgagcctgcggagcccgtggcggggcagggtcaacggcccaaggcctcggccccctcggtccactcctcgttccccaccctccctaccacgg

SEQ ID NO: 392608 - DNA, 659 bp, Homo sapiens
  misc_feature: GZ8MTXP02IF57L.19.80.H03.1.454.CMB.2.raw
  modified_base (264)..(264): a, c, t, g, unknown or other
tcagtactctcgtgcacgaccggtgctcgatttagctgtgcgtcgaagggaaagggccctctgggagagatccccagggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagagtgccctgacctgagccaatganaccagacaggccaagtggtgtgagacccctgaggagctgggccctggtccccaggcagcgctggcccctgctgctgcctgggtcctggccagtcggtccgcccgagttcgggcccttgcccgttcggaccgtcccccgtaaagttcgggttcgaccgaacccggacgaaaaacgggcccgggggaacccccaacgggaacccccgtcgggacgcccgtacgaacggtttacgggaaacggccgaacggcccgaacgtccccgaaggccctggcccgggaggcccgtgggtcgggggcagggtccacggacccgaaacgggcccgtcgccccccgttcgggtcccgtaccgttccgttccggtttcccccggtccccttacccgttcccgaaccgg

SEQ ID NO: 392609 - DNA, 510 bp, Homo sapiens
  misc_feature: GZ8MTXP02IA1FV.19.80.H03.1.454.CMB.2.raw
  modified_base (218)..(218): a, c, t, g, unknown or other
  modified_base (379)..(379): a, c, t, g, unknown or other
  modified_base (389)..(389): a, c, t, g, unknown or other
  modified_base (414)..(414): a, c, t, g, unknown or other
  modified_base (422)..(422): a, c, t, g, unknown or other
  modified_base (448)..(448): a, c, t, g, unknown or other
  modified_base (452)..(452): a, c, t, g, unknown or other
  modified_base (477)..(477): a, c, t, g, unknown or other
  modified_base (488)..(488): a, c, t, g, unknown or other
tcagtactctcgtgcacgaccggtgctcgatttagctgtgcgtcgaagggaaagggccctctgggagagatccccagggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtgccctgaacctgaagcaatgagaccaagacaggccaagtggtgtgagacccctgaggagctgggccctggtccccaggcagcgctggccctgctgctgccctgggtctggccatggtcgcccatcggcctgctgcncccaatggtncacgcaaagcgggaacccagacccnggacgccncagttggaagcagccgatccagccgngcgngcgtgcggcaggcacgccgacgccncgcccgtcgcnctctcgtcccacctcctacacg

SEQ ID NO: 392610 - DNA, 583 bp, Homo sapiens
  misc_feature: GZ8MTXP02F5FK4.19.80.H03.1.454.CMB.2.raw
  modified_base (245)..(245): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagaggtnccctgaacctgaaggccaatgagacccaagacaggccaagtgggtgtgagacccctgaggagctgggccctggtcccaggcagcgctggcccctgctgctgcctgggtctggccatcggtcgccatcggcctgctgccgcccaagtcggttcgccgaccgcgaaaacgccggggaacccaggacccccgtggaacgcctacgagttggaaacgcgacgaccggaatcccgagcctggacggacgccgtggtcgggggctagggccacggcccgaaaggccctacgcccccgtcggtcccacgttcccgtacgttccccctaccctcccgtccaaccgg

SEQ ID NO: 392611 - DNA, 516 bp, Homo sapiens
  misc_feature: GZ8MTXP02I38IO.19.80.H03.1.454.CMB.2.raw
  modified_base (351)..(351): a, c, t, g, unknown or other
  modified_base (359)..(359): a, c, t, g, unknown or other
  modified_base (362)..(362): a, c, t, g, unknown or other
  modified_base (379)..(379): a, c, t, g, unknown or other
  modified_base (396)..(396): a, c, t, g, unknown or other
  modified_base (405)..(405): a, c, t, g, unknown or other
  modified_base (417)..(417): a, c, t, g, unknown or other
  modified_base (498)..(498): a, c, t, g, unknown or other
tcagtactctcgtgcacgaccggtgctcgatttagctgtgcgtcgaagggaaaggggcccgtctgggagagatccccaggggtgacagccatggaccctggaagggcccgggctagggacagggaccagagccagtccagggagaggacagagccaatggactggggtgtactgtaacagccctgctggcgagagggaccagggcaccgtcctccagggagcccatgctgcaagtcgggccagagtgccctgacctgagccaatgagaccagacaggccaagtgggtgtgagacccctgaggagctgggccctggtcccaggcagcgctgggcccctgctgctgctggtcngcatgtcnccntgctgctgcgccatgtncacgcaagcgggacccngacctgacncctcagttgaancagccgatccagcctgcgagccgtgtcgggcaggtcaggcccaaggcctcgccccctggaccaacgtcctcgttacccccncccgtccaccgacgtacg

SEQ ID NO: 392612 - DNA, 606 bp, Homo sapiens
  misc_feature: GZ8MTXP02HV57T.19.80.H03.1.454.CMB.2.raw
  modified_base (286)..(286): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgccctgaacctgaaggccaatgagacccaagacaggccaagngggttgtgagacccctgaggagctggggccctggtcccaggcagcgctggcccctgctgctgcctgggtctggccatcggtcgcccatcggcctgctcgcgccccaagtggttcgccaccggcgaaaacggcgggggaaccccaggaaccccgtgggacgccgtcgtaggtttcggaaacggcgaggcccggaactcccgaaggcccgtggccgggacgccgtcgggtcgggggcacgggtccgacggccccgaaacgggccgtcgcccccgtcgggtccaccgttccgtccgttcccccaccctcccttacccaaccgg

SEQ ID NO: 392613 - DNA, 562 bp, Homo sapiens
  misc_feature: GZ8MTXP02HJT96.19.80.H03.1.454.CMB.2.raw
  modified_base (371)..(371): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaagccaatgagacccaagacaggccaagtgggtgtgagacccctgaggagctgggcccctggtccccaggcagcgctggcccctgctgctgcctgggtctggccatcggtcncccatcggcctgctcgcgcccatgtcgcacgcaaacgcggggaccccagaccctggacgccgtcgagttggaacgcgacgccgatccgacgcctggcggagccggtggtcggggcagggtccgacggcccgaacggccgtccggcccccgtcggtccaccgtcctccgtccccaccctccctaccgaaccg

SEQ ID NO: 392614 - DNA, 447 bp, Homo sapiens
  misc_feature: GZ8MTXP02GVUSG.19.80.H03.1.454.CMB.2.raw
  modified_base (213)..(213): a, c, t, g, unknown or other
  modified_base (241)..(241): a, c, t, g, unknown or other
  modified_base (432)..(447): a, c, t, g, unknown or other
tcagtactctcgtgcacgaccggtgctcgatttagctgtgcgtcgaagggaaagggctggagtgggtggccaacataaagccagatggaagtgagagatcttatgtggactctgtgaagggccgattcagcatctccagagacaacgccaagaattcactgtttctgacaaataaacagcctgagagccgaggacacggctgtctactattgngtgagagagataagatactttgattcgnggggccagggacacggtcaccgtctcttcagccctccaccgaacgggccccagtccggtcccttcccccgtggccgccctgcctccgaggacgccacctccgagagcacacgccggcctgggctgcctggtcaacggactaccgttcccagagacgtactgacgccgggctcggcaagggccgacagtagnnnnnnnnnnnnnnnn

SEQ ID NO: 392615 - DNA, 658 bp, Homo sapiens
  misc_feature: GZ8MTXP02F2DLQ.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggtgtgagacccctgaggagctgggccctggtcccaggcagcgctcgccctgctgctgcctgggtctggcctagtcggtccgcccgagtcggccctgccgtcgccgtccctaaagtcggttcgccgaaccgacgaaaacggcccgggggaccccaacggaccccgtcgggacgcccgtacgacggttacggaacggccgacggacccgactcccgacgcccgtcggccgggacgcccggtgggtcgggggaccgacggggtaccgaccggaccccgaaacgggcccgtccggcccccccgttacggtcccgtaaccgttcccgttcccggttcccccgtcccccgttccccgttacccgaaaccccggg

SEQ ID NO: 392616 - DNA, 593 bp, Homo sapiens
  misc_feature: GZ8MTXP02HT1XM.19.80.H03.1.454.CMB.2.raw
  modified_base (297)..(297): a, c, t, g, unknown or other
  modified_base (373)..(373): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaagtgggttgngagaccccctgaggagctgggccctggtcccaggcagcgctggcccctgctgctgcctgggtctggccatcggtcncccgatcggcctgctcgcgcccaatggttcgcacgcaaacgcggggacccaggacccctggaaccctcgagttcggaagtcgacgccgatccgagccgtagcggagccgtggtcggggcgacgggtcgacggacccgaaacgggcccgtccggcccccgtcggtccctaaccgtcccgtccgtttccccgacccctttacccgtcccgtaccgtaaccgg

SEQ ID NO: 392617 - DNA, 572 bp, Homo sapiens
  misc_feature: GZ8MTXP02HDCXG.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctgggccctggtcccaggcagcgctggccctgctgctgcctgggtctggccagtcggtcgcccgatcgggcctgcctgcgcccagtgtcgcacgcgaaacgcgggacccacgacccgtggacgccgtcgacgttaggacgcgaggccgaactcccgagccgtggcggagcccgtggtcggggcgacgggtccgacggcccgaaacggccgtccgcccccgtcggtccaccgtcctccgttccccaccctccctaccgaaccg

SEQ ID NO: 392618 - DNA, 526 bp, Homo sapiens
  misc_feature: GZ8MTXP02GA4K8.19.80.H03.1.454.CMB.2.raw
  modified_base (395)..(395): a, c, t, g, unknown or other
  modified_base (425)..(425): a, c, t, g, unknown or other
  modified_base (451)..(451): a, c, t, g, unknown or other
  modified_base (459)..(459): a, c, t, g, unknown or other
  modified_base (467)..(467): a, c, t, g, unknown or other
tcagtactctcgtgcacgaccggtgctcgatttagctgtgcgtcgaagggaaaggggccctctgggagagatcccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaagtgggtgtgagacccctgaggagctggggccctggtcccaggcagcgctggcccctgctgctgcctgggtctggccatggtcgcccatggcctgctgcgcccaatgtncacgcaaagcggggacccagaccctggacncctcagttgaagcagccgatccagcngcgagcgngtgggcgnggcgacgccaacggcgcgcccgtccggtccgactcctcgtccctaccctcccaccgacg

SEQ ID NO: 392619 - DNA, 597 bp, Homo sapiens
  misc_feature: GZ8MTXP02HS5OP.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggtgtgagacccctgaggagcgtgggccctggtcccaggcagcgctcggcccctgctgctgcccgtgggtcctgccatcggtcgcccatcggcctcgctgccgtcccagtggtcgcaccgcgaaaacggcggggaccccaaggaccccgtgggaccgccgtacgacggttgaacggcgacgaccggaactcccgacgccgtcggacggacgtccgtggtcggggcgacgggtccacggcccgaaaggcccttaccggcccccgttggaacctccgtcctacgtccccctaccctcccgtaccaaccgg

SEQ ID NO: 392620 - DNA, 617 bp, Homo sapiens
  misc_feature: GZ8MTXP02GB5O5.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgaggagctggggccctggtccccaggcagcgctggcccctgctgctgcctgggtctggccagtcggtcgcccgatcgggccctgctgccgcccaagtcggttacgcgaccgcgaaacggccggggacccacggaccccgtggaccgcctcgaggttcggaagcgacgaccgacgtcccgagcccgtggccggacggccgtgggtcggggacgacgggtccgaacggcccgaaacgggtcccgtaccggtcccccgtccgggtcctaccgttcccgttcccggttccccctaccccctcccgtacccgaaccgg

SEQ ID NO: 392621 - DNA, 686 bp, Homo sapiens
  misc_feature: GZ8MTXP02JHJJM.19.80.H03.1.454.CMB.2.raw
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaagtgggtgtgagacccctgaggagctgggccctggtcccaggcagcgctggccctgctgctgcctgggtctggccagtcggtcgcccgatcgggccctgcctcggccgccccaaagtcgggttcgccacccggcaaaacggcgggggaccccaggacccccgtgggacgcccgtaccgaggtttcgggaaacgccgaacggcccggaaacgtccccgaaggaccccgtacgggccggggaacggtccccggttagggtcgggggtccgaacgggggttccgaaacgggcccccgaaaacggggccccgttaccgggcccccccgttccggggtccctaacccggttacccgttcccggtttcccccggaccccctttccccgttccccgtaaaccccggg

SEQ ID NO: 392622 - DNA, 583 bp, Homo sapiens
  misc_feature: GZ8MTXP02JCO3K.19.80.H03.1.454.CMB.2.raw
  modified_base (294)..(294): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtgcccctgaacctgaaggccaatgagacccaagacagcaagtggtgngagccctgaggagctgggccctggcccaggcagcgctcggccctgctgctgccgtgggctggcctagtcggtcgccgatcggcctgctcgccgcccaagtcggtcgccaccgacgaaacggccgggacccacgacccgtggacgcctcgagttggaaacgcacggccgactccgacgcccgtggcggacgccgtggtcggggcgaggtcgacggacccgaacgggcctaccggccccgtcggtccacccgttcccgtccgttcccccaccctccccgtacctaacccgg

SEQ ID NO: 392623 - DNA, 536 bp, Homo sapiens
  misc_feature: GZ8MTXP02JB9YT.19.80.H03.1.454.CMB.2.raw
  modified_base (242)..(242): a, c, t, g, unknown or other
  modified_base (369)..(369): a, c, t, g, unknown or other
  modified_base (454)..(454): a, c, t, g, unknown or other
  modified_base (515)..(515): a, c, t, g, unknown or other
  modified_base (526)..(526): a, c, t, g, unknown or other
  modified_base (534)..(534): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagnggtgcccctgaacctgaaggccaatgagacccaagacaggccaagtgggtgtgagacccctgaggagctgggccctggcccaggcagcgctggcccctgctgctgcctgggtctggccagtcggtcncccagtcggcctgctgccgccaagtggtcgcacgcgaaacgcgggacccagacccgtggacgctcgaggttcggaagcagccgancccgagccctggcggagccgtggcggggcagggtcacggccaaggctcgcccctcggcccnctctcgtcccncctccacncg

SEQ ID NO: 392624 - DNA, 632 bp, Homo sapiens
  misc_feature: GZ8MTXP02JLOH3.19.80.H03.1.454.CMB.2.raw
  modified_base (294)..(294): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggcagaggtgcccctgaacctgaagccaatgagacccaagacaggccaagtggtgngagacccctgaggagcgtgggccctggtcccaggccaggccgctcggccctgctgctgccgtgggtctggccagtcggtccgcccgagtcggccgtgccgtcgccgcccgtaagtcggttcgccgaccgaccgaaaacgggccggggaccccaggaccccgtgggaccgcccgtaccgaggttagggaacgcgacggccgaactccgaacgccgtaggcggacgcccgtggcgggggcaggggtccacgggccccgaaacggtcccgtccggccccccgtgggtcccctacgttccccgttaccggttccccctaccccctccccgtacccgaaccgg

SEQ ID NO: 392625 - DNA, 592 bp, Homo sapiens
  misc_feature: GZ8MTXP02GGS5N.19.80.H03.1.454.CMB.2.raw
  modified_base (218)..(218): a, c, t, g, unknown or other
  modified_base (241)..(241): a, c, t, g, unknown or other
  modified_base (461)..(461): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagganccatgctgcaagtcggcagagtnccctgaacctgaagccaatgagaccaagacaggcaagtggtgtgagaccctgaggagctgggccctggtcccaggcagcgctggccctgctgctgctgggtctggccagtcggtcgccccgagtcggcctgctcgcgcccaagtggttcgcaccgacgaaacggccgggacccacgaaccccgtgggacgccgtacgaggttaggaacgcgaggccgacncccgacgcccgtggcggacgcgtggtcgggacgtacggtaccgacggacccgaacggtcccgtcccggtcccccgtacggtcccgtaccgttccgttacccggttccccgcccgttcccgtacccgtaacg

SEQ ID NO: 392626 - DNA, 591 bp, Homo sapiens
  misc_feature: GZ8MTXP02F6N3R.19.80.H03.1.454.CMB.2.raw
  modified_base (368)..(368): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgccctgaacctgaagccaatgagacccaagacaggccaagtgggtgtgagacccctgaggagctgggccctggtcccaggcagcgctggcccctgctgctgcctgggtctggccagtcggtcncccgatcggcctgcctgccgcccaatcggttgccaccgcgaaacgccggggacccaggaccccgtgggacgcctacgagttggaaacgcgagcccggatcccgagccctaggccggacgcccgtgggtcggggcgacgggtcacggcccgaaacgggcccttccggcccccgttcgggccaccgttcctaccggttcccccaccccgtccctaccgaacccgg

SEQ ID NO: 392627 - DNA, 584 bp, Homo sapiens
  misc_feature: GZ8MTXP02I8SUD.19.80.H03.1.454.CMB.2.raw
  modified_base (332)..(332): a, c, t, g, unknown or other
  modified_base (376)..(376): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagacccaagacaggccaagtggtgtgagacccctgaggagctgggccccgtcgacgcgacgcgcncgcccgtcgctcgctgcgtcggtcgtcgcgacgtggtccgcccncgtcggccgtcgcgtcgcgccgaactgttcgcgaccgcgaaacgccgggaccgaccgaccgtcgacgcctcgagttggaacgcgacgaccgactaccgacgccgacgcggacgccgtggtgggcgacggacgacggcccgaaacggccgtcggcccccgtcggtccgaaccgtcctcggttacccctccctacccgtccgaccgaacg

SEQ ID NO: 392628 - DNA, 615 bp, Homo sapiens
  misc_feature: GZ8MTXP02G4CDR.19.80.H03.1.454.CMB.2.raw
  modified_base (220)..(220): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtncccctgaacctgaaggccaatgagacccaagacaggccaagtggtgtgacgacccctgaggagcgtgggccctggtcccaggcagcgctcggccctgctgctgccgtgggtctggccagtcggtccgcccgagtcggcctgccgtcgccgtccctaagtcggttcgccgaccgacgaaacggaccggggaccccacggaccccgtggaccgccgtagacggttaggaacgcgacgccgacgtccgacgccgtggcggtacgccgtgggtcggggcctacgggccgacggcccgaaacggcccgtccggcccccgttccggcctaccgttcccgtcccgttcccccaccccgttcccgtacccgaaccgg

SEQ ID NO: 392629 - DNA, 598 bp, Homo sapiens
  misc_feature: GZ8MTXP02J2MRU.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcgggccaggacggtcgcccctgaacctgaacggccaatgagacccaagacaggccaagtggtgtgacgacccctgacggagctggggccctggcccaggcagcgctcggcccctgcctgctgcctgggtctggccagtcggtcgcccagtcggcctgcctcgccgcccaagtcggtcgcgaccgcgaaacggccggggacccacggacccgtgggacgccgtacgacggttggaacgcgacgacccgaatccgacgccgtggcggacgccgtgggcggggcgacgggcacggacccgaacgggcctcccggcccccgtcggtcctccgtcctccgtttacccccaccctcccgtaccgtacg

SEQ ID NO: 392630 - DNA, 649 bp, Homo sapiens
  misc_feature: GZ8MTXP02HGV41.19.80.H03.1.454.CMB.2.raw
  modified_base (219)..(219): a, c, t, g, unknown or other
  modified_base (265)..(265): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtctccagggancccatgctgcaagtcggcagagtgccctgaacctgaagccaatganacccaagacaggccaagtcggtgtgagacccctgaggagctgggccctggtccccaggcagcgctcggccctgctgctgcctgggtctggccagtcggcgcccgatggcctgctcgccgcccaagtcggttcgccgaccgacgaaaacgccgggggaaccccacggaaccccgtgggaaccgccgttaccgaggtttcgggaaagccgacggacccgaacgtcccgacgcccgtggccgggtagcccgtggtacgggggtccgaacggggttccgaaaccggcccggtaaacgggccttaccgggccccccgttaccggggttccaacccggtttccccttaccggtttaccccccctaccccgttccccgtacccgtaaccgg

SEQ ID NO: 392631 - DNA, 641 bp, Homo sapiens
  misc_feature: GZ8MTXP02JIUQ7.19.80.H03.1.454.CMB.2.raw
  modified_base (371)..(371): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagagtgccctgaacctgaagccaatgagacccaagacaggccaagtgggttgtgagacccctgaggagctgggcccctggtccccaggcagcgctcggcccctgctgctgccctgggtctggccagtcggtcncccgagtcggccgtgcctcgccgcccaatggttcgcaccgcgaaaacggccggggacccacggaccccgtgggacgccgtacgacggttcggaaacgccgaacggcccgacgtcccgaacggcccgtcggccgggacgcccggttgggtcgggggtaccgacggggtccgaacgggtaccccgaaacgggcccgttaccggccccccgttccgggtcctacccgttcccgttccggttcccccgtcccccttcccgtcccgtaaacccgg

SEQ ID NO: 392632 - DNA, 564 bp, Homo sapiens
  misc_feature: GZ8MTXP02I02BL.19.80.H03.1.454.CMB.2.raw
  modified_base (241)..(241): a, c, t, g, unknown or other
  modified_base (459)..(459): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagngtgccctgacctgagccaatgagacccaagacaggccaagtgggtgtgagacccctgaggagctggggccctggtcccaggcagcgctggcccctgctgctgcctgggtctggccagtcggtcgcccatcggcctgctgcgcccatgtgcacgcaaacgcgggacccagacccgtggacgcctcgagttcgggaagtcgagccgaactcccgagtccnggcggacgcccgtggtcgggggcacgggtccacggcccaagggcctcggcccccgtggtcccaccgttcctccggtttcccccacccgtcccttacccgaaccgg

SEQ ID NO: 392633 - DNA, 601 bp, Homo sapiens
  misc_feature: GZ8MTXP02J1DZ2.19.80.H03.1.454.CMB.2.raw
  modified_base (361)..(361): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgccctgaacctgaagccaatgagacccaagacaggccaagtgggttgtgagacccctgaggagctgggccctggtcccaggcagcgctggcccctgctgctgcctgggtctggccngtcggtcgcccgagtcggcctgctcgcgcccagtgtgccaccgcaaacggccggggacccacggaccccgtggacgcccgtcgacggttggagcgagcccgatccgagccgtggccggagtccgtgggtcggggccgaggggtccacggaccccgaacgggccctccggtccccccgttcggtcccgtaccgttcccgtcccggtttacccccaccccgttacccgtaccccgaacccgg

SEQ ID NO: 392634 - DNA, 619 bp, Homo sapiens
  misc_feature: GZ8MTXP02GJL27.19.80.H03.1.454.CMB.2.raw
  modified_base (168)..(168): a, c, t, g, unknown or other
  modified_base (221)..(221): a, c, t, g, unknown or other
  modified_base (244)..(244): a, c, t, g, unknown or other
  modified_base (248)..(248): a, c, t, g, unknown or other
  modified_base (491)..(491): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacncccatgctgcaagtcgggccagngtcnccctgaacctgaagccaatgagacccaagacaggccaagtgggtgtgacgacccctgaggagcgtgggccctggtcccaggcagcgctcggcccctgctgctgcctgggctggcctagtcggcgccagtcggcctgctcgcgtcccaagtcgtcgcgaccgacgaaacgccggggacccacggaccccgtgggacgccgtacgacggttacggaacgcgacgcccgaactcccgacgtcccgnggcggacgccggtgggtcggggacgagggtccgacggaccccgaacgggcccgtcccggcccccgttcggtcccgtcccgttcccgttcccggttcccccgtcccccgtccccgttcccgaaacccgg

SEQ ID NO: 392635 - DNA, 550 bp, Homo sapiens
  misc_feature: GZ8MTXP02G4RBZ.19.80.H03.1.454.CMB.2.raw
  modified_base (267)..(267): a, c, t, g, unknown or other
  modified_base (356)..(356): a, c, t, g, unknown or other
  modified_base (361)..(361): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgcccctgaacctgaaggccaangagacccaagacaggccaagtgggtgtgagacccctgagagctgggccctggtcccaggcagcgctggccctgctgctgcctggctgcntcgcnccatcggcctgctcgcgcccaagtcgtcgcaccgcgaaacgcgggacccacggaccctggacgcctcgagttcggaacgcgagccgatccgagccgtgcggacgccgtggtggggcgacggtcacggcccgaaggccctcgcccccgtcgtccgaccgtccgtccgttccccgccctacccgtcgaccg

SEQ ID NO: 392636 - DNA, 624 bp, Homo sapiens
  misc_feature: GZ8MTXP02J13GN.19.80.H03.1.454.CMB.2.raw
  modified_base (341)..(341): a, c, t, g, unknown or other
  modified_base (505)..(505): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccaggaggtcgcccctgaacctgaaggccaatgagacccaagacaggccaaagtgggttgtgagaccccgtgaggagctgggccctggtcccaggcagcgcncggccctgctgctgccgtgggtctcggccagtcgggtcgcccgagtcggcctgctcggccgaccccgaagtcggttcgccgacccgacgaaacggccggggacccacggacccgtggacgccgtacgaggttcggaacgcgacgcccggaactccgacggccgnggccgggacgccgttcgggcggggacgaacgggcgaccggcccgaacgggcccgtccggtcccccgtcgggtcctaccgttccgtcccggttacccctccccttcccgccgaaacccgg

SEQ ID NO: 392637 - DNA, 562 bp, Homo sapiens
  misc_feature: GZ8MTXP02JNN39.19.80.H03.1.454.CMB.2.raw
  modified_base (459)..(459): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagagtgccctgaacctgaagccaatgagacccaagacaggccaagtggtgtgagacccctgaggagctgggccctggtcccaggcagcgctggcccctgctgctgccgtgggtctggcccagtcggtcgcccgatcggcctgcctgcgcccaatcggttgccaccgcgaaacgcggggacccaggacccgtggacgcctcgacgttggaacgcagccganccgagccctggcggagcccgtggtcggggcacgggtcgacggcccaaggcctccggccccctcggccacgtcctacgtccccacccgtccctaccgaacccgg

SEQ ID NO: 392638 - DNA, 625 bp, Homo sapiens
  misc_feature: GZ8MTXP02HWJ14.19.80.H03.1.454.CMB.2.raw
  modified_base (220)..(220): a, c, t, g, unknown or other
  modified_base (289)..(289): a, c, t, g, unknown or other
  modified_base (366)..(366): a, c, t, g, unknown or other
  modified_base (387)..(387): a, c, t, g, unknown or other
  modified_base (433)..(433): a, c, t, g, unknown or other
tcagtactctcgtggcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggancccatgctgcaagtcggcagaggtgccctgaacctgaagccaatgagacccagacaggccaagtggtgngagacccctgaggagcgtgggccctggtcccaggcagcgctcggccctgctgctgccgtgggtctggccagtcggcncccagtcggcctgctcgaccncccaatggtcgcgaccgacgaaacggccggggaaccacggaccccngggactccgtcgaggttcggaaacgcgaacggccgaacgtccgaggccccggtacggacgggacgtccggtcggggtcggggacggacgggtaccgaaccggacccgtaacggccccgtcccgtcccccgtacggtcccgtacccgttcccgttacccgttaccccctacccccgttcccgtacccgtacgg

SEQ ID NO: 392639 - DNA, 608 bp, Homo sapiens
  misc_feature: GZ8MTXP02H936C.19.80.H03.1.454.CMB.2.raw
  modified_base (379)..(379): a, c, t, g, unknown or other
  modified_base (404)..(404): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggacgcccatgctgcaagtcggccagaggtgcccctgaacctgaaggccaatgagacccaagacaggaccaagtgggtgtgacgacccctggaggagcgtgggccctggtccccaggcagcgctcggccctgctgctgcctgggtctggccagtcgggtccncccagttcggccgtgcctcggaccncccacgtcggtcgccgaccgacgaacgaccggggacccgacggtacccgcggacgccgtacgacggttcggaaacgcgacggccgaacgtccacgcccgtggaccggcgcccggtggcgggggcgacggtccgacgccgaacggccgccgtccccgtccggtaacccgtctccgtcctcccctacccgtccctacccgaaccgg

SEQ ID NO: 392640 - DNA, 569 bp, Homo sapiens
  misc_feature: GZ8MTXP02GI0FM.19.80.H03.1.454.CMB.2.raw
  modified_base (245)..(245): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtncccctgaacctgaaggccaatgagacccaagacaggccaaagtgggttgtgagaccccctgaggagctgggccctggtcccaggcagcgctggcccctgctgctgcctgggtctggccatcggtcgcccatcggcctgctgcgcccaatggttagcaccgcaaacgcggggacccaggaccccgtggacgcctcgagttggaagcagccggatcccgagcctgcggagcccgtggtcggggcagggtccaggcccgaaagggcctcggcccccgtcgggtcctaccgtcgtccgtttcccccggcccttccctacccgaaccgg

SEQ ID NO: 392641 - DNA, 582 bp, Homo sapiens
  misc_feature: GZ8MTXP02GDZ3P.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaagtcgggcagaggtcgcccctgaacctgaacggccaatgagacccaagacaggccaaagtgggttgtgagacccctgaggagctgggccctggtccccaggcaggcgctcggcccctgctgctgccgtggtctggccagtcggtcgcccgatcggcctgcctgcgcccatggtcgcgaccgcgaaacggccggggacccagacccgtggacgccgtcgaggttcggaagcgacgccgatcccgagcctaggcggacgccgtggcgggcgaggtccacggcccgaacggtcctccggccccctcggtccctaccgtccgttcggtcccccgtcctcccgtcctaaccgg

SEQ ID NO: 392642 - DNA, 547 bp, Homo sapiens
  misc_feature: GZ8MTXP02JFQQV.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcttccagggagcccatgctgcaagtcgggccagaggtgcccctgaacctgaaggccaatgagacccaagacaggccaagtgggtgtgagacccctgaggagctgggccctggtcccaggcagcgctggcccctgctgctgcctgggtctggccagtcggtcgcccatcggcctgctgcgcccatgtgcacgcaaagcgggacccagaccctggacgcctcgagttggaacgcagccgatcccgagcctgcgagccgtggtggggcagggtccacggccccaagggcctcggccccctcggtccacgttccgtcgttcccccaccctcctaccaaccgg

SEQ ID NO: 392643 - DNA, 564 bp, Homo sapiens
  misc_feature: GZ8MTXP02JD8ST.19.80.H03.1.454.CMB.2.raw
  modified_base (220)..(220): a, c, t, g, unknown or other
  modified_base (389)..(389): a, c, t, g, unknown or other
  modified_base (450)..(450): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcggcagagtgccctgacctgaagcaatgagaccaagacaggccaagtggtgtgagacccctgaggagctgggccctggtcccaggcagcgctggcccctgctgctgcctgggtctggccagtcggtcgcccatcggcctgctgcgcccagtgttncaccgcaaacgcgggacccagacccgtggacgcctcgaggttggaacgcgacgccggaacnccgacgccgtggcggacgtccgtggtcgggacgtacggcgaccggaccgaacggcccgtaccgcccccgtcggtccgtccgttccgtcccgtccccgtccctcccgtaccgacg

SEQ ID NO: 392644 - DNA, 697 bp, Homo sapiens
  misc_feature: GZ8MTXP02IQ35O.19.80.H03.1.454.CMB.2.raw
  modified_base (242)..(242): a, c, t, g, unknown or other
  modified_base (371)..(371): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctgcaagtcggcagnggtgccctgaacctgaagccaatgagacccaagacaggccaaagtgggttgtgagaccccctggaggagctgggccctggtccccaggcagcgctgccctgctgctgcctgggtctggccagtcggtcnccccgagtcggccctggcctcggccgtcccgaaagtggttacgccgacccggacgaaaacgggccgggggaaccccaacggacccccgtagggaccgtacccgtaccgtaaggttcgggaaacgaccgacgggacccgaagttcccgaacggcccgttcggcccggggacgtacccggtgggggtcgggggtccgaacggggttcccgaacgggaccccgtaaacggggccctacccgggtcccccccgttgggggttaaccccgtaaccttccccgttcccggttaaccccccgtacccctttcccccggttacccaaacccggg

SEQ ID NO: 392645 - DNA, 635 bp, Homo sapiens
  misc_feature: GZ8MTXP02JSB9Z.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccaaggcaccgtcctccagggagcccatgctgcaagtcgggccagaggtgcccctgaacctgaaggccaatgagacccaagacaggccaaagtgggttgtgagacccctgaggagctgggccctggtcccaggcagcgctggcccctgctgctgccctggggtctggccagtcggtcgcccgagtcgggccctgccgtcgccgccctaagttcgtttcgccacccgcgaaaacggccggggaaccccaggaccccgtgggacgcccgtcgaggttacggaacgcgacggcccgatcccgaagcccgtggccggacgccgtgggtcggggcgacgggtccgacggccccgaaacgggtcccgtcccggtccccccgtacgggtcccgaccgttcccgttccgttcccccgtcccccttccccgttacccgaaacccggg

SEQ ID NO: 392646 - DNA, 637 bp, Homo sapiens
  misc_feature: GZ8MTXP02F1R7I.19.80.H03.1.454.CMB.2.raw
  modified_base (524)..(524): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggagcccatgctgcaagtcggccagaggtgcccctgaacctgaaggccaatgagacccaagacaggccaagtggttgtgagacccctgaggagctgggccctggtcccaggcagcgctcggcccctgctgctgccgtgggtctggccagtcggtccgcccgagtcgggccctgccgtcggccgcccgtaaagttcggttcgccgaccggacgaaaacggcccgggggaccccaacggaccccgtcgggaacgtcccgtacgacggttacgggaacgccgacggacccggactacccgacggtcccncggccggacgcccgtgggtcggggcgaggtccgacggcccgaacggcccgtccggcccccgtcggtcccgtaccgttccgtccgttccccgcccttcccgacccgtaaaccgg

SEQ ID NO: 392647 - DNA, 574 bp, Homo sapiens
  misc_feature: GZ8MTXP02JJNVP.19.80.H03.1.454.CMB.2.raw
  modified_base (367)..(367): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtggtgtgagacccctgaggagctgggccctggtcccaggcagcgctggccctgctgctgctgggtctggccagtggtcnccgagtcggcctgctcgccgcccgaaagtcggttacgcgaccgcgaaaacggccggggaacccacggacccgtgggacgccgtacgaggttacggaacgcgacggtccgaatcccgagcctggcggacgccgtgcggggctacgggcgacggccgaacggcctcgcccctcggtccacgtccgtccgtcccgccctccgtccgaccg

SEQ ID NO: 392648 - DNA, 562 bp, Homo sapiens
  misc_feature: GZ8MTXP02IW1LN.19.80.H03.1.454.CMB.2.raw
  modified_base (221)..(221): a, c, t, g, unknown or other
  modified_base (242)..(242): a, c, t, g, unknown or other
  modified_base (246)..(246): a, c, t, g, unknown or other
  modified_base (266)..(266): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcggcagnggtnccctgacctgaagcaatganccaagcagccaagtggtgtgagccctgaggagctgggccctggtcccaggcagcgctggccctgctgctgcctgggtctggccagtcggtcgcccgatcggcctgcctgccgcccagtgtgcacgcgaaacgcgggacccaggaccctggacgccgtcgaggttcggaagcgacgccgactccgagccgtagcggagcccgtggtcggggcacgggtcacggcccgaacgggcctccggcccccgtcgggtccctaccgtccgttccgttccccgccccttcccgtccctaaccgg

SEQ ID NO: 392649 - DNA, 580 bp, Homo sapiens
  misc_feature: GZ8MTXP02IIILX.19.80.H03.1.454.CMB.2.raw
  modified_base (222)..(222): a, c, t, g, unknown or other
  modified_base (376)..(376): a, c, t, g, unknown or other
  modified_base (394)..(394): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcggccagaggtcgcccctgaacctgaacgccaatgagacccaagacaggccaaagtgggtgtgagacccctgaggagctgggccctggtccccaggcagcgctggcccctgctgctgcctgggtctggccagtcggtcncccgatcggcctgctgcncccatgtcgcacgcgaaacgcgggaccacgacccgtggacgcctcgagttcggaagcgagccgatccagcctaggcggacgccgtggtcggggcacgggtccgacgcccgaaacgggccgtaccgtcccccgtcgggtcctaccgtcccgttccgttcccccgaccccttcccgtacccgaaccgg

SEQ ID NO: 392650 - DNA, 644 bp, Homo sapiens
  misc_feature: GZ8MTXP02I16O3.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgtgccagaggtgcccctgaacctgaaggccaatgagacccaagacaggccaagtgggtgtgagacccctgaggagcgtggccctggtccccaggcagcgcgtcggcccctgctgctgctgggtctggccagtcggtcgccagtcggcctgctgccgcccagtcggtcgcacgacgaaacggccggggaacccacggacccgtaggacgcccgtacgacgggttacggaacgccgaacggcccgaacgtcccgaacgcccgtacggccggggacgtcccggtacgggtacgggggccgtaacgggtccgaacgggtaccccgaacgggccccgttccggcccccgttccggggtcctaacccgttcccgttcccggttccccccggtcccctttaaccccgtaccccgg

SEQ ID NO: 392651 - DNA, 602 bp, Homo sapiens
  misc_feature: GZ8MTXP02JBRPK.19.80.H03.1.454.CMB.2.raw
  modified_base (220)..(220): a, c, t, g, unknown or other
  modified_base (373)..(373): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaaagtgggtgtgagacccctgaggagctgggccctggtcccaggcaggcgcgtggcccctgctgctgcctgggtctggccagtcggcncccgatcggcctgctgccgcccaagtcggttcgcaccggcaaacggccggggacccacggaccctgggacgcctacgaggttaggaacgcgaggccgactcccgaagcccgtaggcggacggcccgttgggacgggggcgaacgggtccacgggccccgaaagggtccgtaccggcccccgtacggtccgaccgtccgtaccgttccccgcccctccgtacccgaccgg

SEQ ID NO: 392652 - DNA, 648 bp, Homo sapiens
  misc_feature: GZ8MTXP02FPF89.19.80.H03.1.454.CMB.2.raw
  modified_base (223)..(223): a, c, t, g, unknown or other
  modified_base (245)..(245): a, c, t, g, unknown or other
  modified_base (249)..(249): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacncccatgctgcaagtcgggcagnggtnccctgaacctgaagccaatgagacccaagacaggccaagtgggtgtgagacccctgaggagcgtgggccctggtcccaggcagcgctcggcccctgctgctgcctgggtctggccagtcggtcgcccgagtcggcctgcgtacgccgcccaagtcggttcgccgaaccgcgaaaacgggcccggggaaccccacggaccccgtgggacgcccgtacgaggttacgggaaacgccgacgaccggactacccgagcccgtggaccggacgcccgttgggcggggacgtacgggccgaacggccccgaaacgggtcccgtcccggccccccgttacggtcccgtaacccgttcccgttccggttacccccctaccccttccccgttaccccgtaaacccggg

SEQ ID NO: 392653 - DNA, 619 bp, Homo sapiens
  misc_feature: GZ8MTXP02FLPFR.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaagtgggtgtgagacccctgaggagctgggccctggtcccaggcagcgctggcccctgctgctgcctgggtctggccagtcggtcgcccagtcggcctgctcgccgcccaagtggttcgcgaccgacgaaacggccggggaaccccaggaccccgtgggaacgcccgtacgacggttacgggaacgcgacggccgaacgtcccgagccgtggcggacgccgtggtcgggggcacggggtccaacgggccccgaagggcccgtccggccccccgttacgggtcctaccgttccgtaccggtttcccccaaccccttcccgtacccgaaacccgg

SEQ ID NO: 392654 - DNA, 581 bp, Homo sapiens
  misc_feature: GZ8MTXP02GOYL9.19.80.H03.1.454.CMB.2.raw
  modified_base (220)..(220): a, c, t, g, unknown or other
  modified_base (468)..(468): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctgaacctgaaggccaatgagacccaagacaggccaagtgggtgtgagacccctgaggagctggggccctggtcccaggcagcgctggcccctgctgctgcctggtctggcagtcggtcgcccagtcggcctgctcgccgcccaagtggttcgcaccgacgaaacggcgggacccacggacccgtagggcgcctcgagttcggaacgcgagccgtancccgagcccgtgcggagtcccgtggcggggcacggtcaacggcccgaagggccctccgcccccgtacggtccctaccgtccgtaccgttccccaccctccctaccgaacccgg

SEQ ID NO: 392655 - DNA, 590 bp, Homo sapiens
  misc_feature: GZ8MTXP02H53G8.19.80.H03.1.454.CMB.2.raw
  modified_base (221)..(221): a, c, t, g, unknown or other
  modified_base (297)..(297): a, c, t, g, unknown or other
  modified_base (405)..(405): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggancccatgctgcaagtcgggccagaggtcgccctgaacctgaaggccaatgagacccaagacaggccaagtgggttgngagacccctgaggagcgtgggccctggtccccaggcagcgctcggcccctgctgctgcctgggtctggccagtcggtcgcccagtcggcctgctcgcgcccagtgtcncgaccgacgaaacgccggggacccacgaccccgtggacgcctacgaggttacggaacgcgacggccgatacccgagcccgtaggcggacgtccgtggtcgggggcagggtccgaacggcccgaacgggcctccggcccccgtcggtcctaccgtcctcgttccccaccctccgtacccgaaccgg

SEQ ID NO: 392656 - DNA, 564 bp, Homo sapiens
  misc_feature: GZ8MTXP02IERXG.19.80.H03.1.454.CMB.2.raw
  modified_base (219)..(219): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtgccactgaacctgaaaggccaatgagacccaagacaggccaagtggtgtgagacccctgaggagctgggccctggtcccaggcagcgctggcccctgcctgctgctgggtctggcatggtcgcccatgggcctgctgccgcccaatcggttgccaccggcaaacggccggggaaccccaggaccctggacgcctcgagttggaagcagcccgagtccagccgtgcggagccgtgtcggggccagggtccacggcccgtaacggccttcgccccccgtcggtcccacgtcccgtccgtttcccccgcccttcccgtacccg

SEQ ID NO: 392657 - DNA, 594 bp, Homo sapiens
  misc_feature: GZ8MTXP02H0GRO.19.80.H03.1.454.CMB.2.raw
  modified_base (367)..(367): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggagcccatgctgcaagtcgggccagaggtcgcccctgaacctgaaggccaatgagacccaagacaggccaaagtgggtgtgacgacccctgaggagctgggccctggtcccaggcagcgctggcccctgctgctgcctgggtctggccntcggtcgccgatcggcctgctcgcgcccatcggtcgcacgcgaaacgccggggacccacgacccgtggacgccgtacgaggttggaacgcgacggccgactcccgacgcccgtacggcggacgtcccgtgggtcgggggcgacgggttcgacggacccgaacgggccgtccggcccccgtcggtccctacgtcccgttccgtttccccgcccgtccctaccgaccgg

SEQ ID NO: 392658 - DNA, 605 bp, Homo sapiens
  misc_feature: GZ8MTXP02JRGG0.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtgcccctgaacctgaaggccaatgagacccaagacaggccaagtggtgtgagacccctgaggagctgggccctggtcccaggcagcgctcggccctgcctgctgcctggtctggccagtcggtcgcccgagtcggcctgctcgccgcccagtcgtcgccgacgacgaaacggccgggacccacgacccgtggacgccgtacgacggttcggaacgccgacggccgactcccgagcccgtggccggacgccgtgggacggggcgaagggccgacggcccgaacgggtccgtcccggtccccctcgggtccctacccgttccgtacccgtccccctacccctcccgtacccgtaacccgg

SEQ ID NO: 392659 - DNA, 588 bp, Homo sapiens
  misc_feature: GZ8MTXP02FG7K3.19.80.H03.1.454.CMB.2.raw
  modified_base (212)..(212): a, c, t, g, unknown or other
  modified_base (220)..(220): a, c, t, g, unknown or other
  modified_base (245)..(245): a, c, t, g, unknown or other
  modified_base (490)..(490): a, c, t, g, unknown or other
  modified_base (500)..(500): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtccnccgaggancccatgctgcaagtcggcagaggtnccctgaacctgaaggccaatgagacccaagacaggccaagtgggtgtgagacccctgaggagctgggccctggtcccaggcagcgctggcccctgctgctgccctgggtctggcccagtcggtcgcccgatcggcctgctgcccgccctaaagtcggttcgaccgaaccgacgaaaacggccgggggaaccccaggaacccccggcggacgtaccgtacgtaggtacggaacgcgacgaccgacnccgacgccgnggcgacgcgtggcgggacgacggcgacgaccgacgcccgtccgtcccgtcgtccgtacgtccgtccgtcccgtccctcccgaccgacg

SEQ ID NO: 392660 - DNA, 574 bp, Homo sapiens
  misc_feature: GZ8MTXP02GNSVJ.19.80.H03.1.454.CMB.2.raw
  modified_base (221)..(221): a, c, t, g, unknown or other
  modified_base (262)..(262): a, c, t, g, unknown or other
  modified_base (354)..(354): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcggcagagtgccctgacctgaagcaangagaccagacaggcaagtggtgtgagcccctgaggagcgtgggccctggtcccaggcagcgcgtcggccctgcctgctgctgggtctggccngtcggtcgcccgatcgggcctgcctgcgcccatgtcgcaccgcgaaacgcgggacccagacccgtggacgccgtcgagttggaacgcgacgccggatccgagccgtcggcggcgccgtgggcggggcagggtccgacggcccgaaacgggccgtccggccccccgtacggttccccgtaccgttcccgtcccgtcccccgtcccctacccgtcccgtacg

SEQ ID NO: 392661 - DNA, 607 bp, Homo sapiens
  misc_feature: GZ8MTXP02H2S02.19.80.H03.1.454.CMB.2.raw
  modified_base (220)..(220): a, c, t, g, unknown or other
  modified_base (265)..(265): a, c, t, g, unknown or other
  modified_base (282)..(282): a, c, t, g, unknown or other
  modified_base (289)..(289): a, c, t, g, unknown or other
  modified_base (314)..(314): a, c, t, g, unknown or other
  modified_base (358)..(358): a, c, t, g, unknown or other
  modified_base (546)..(546): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcggcaggagtcgccctgaacctgagcatganaccagacagcagtggtngagcccngaggagctgggccctggcccaggcngcgctcggccctgctgctgccgtgggtctcggcctagtcggtcncccgagtcggcctgcctcggcctcccgtaatcgggttcgccgaccggacgaaacgggccggggacccgaacggaccccgtacgggacgtccgtacgtacggttcggaaacgtcgaggacccgactccgacgccgtcggcggtacgccgtggacggggtcaacgggtccgacgacccgaacgggtcccnccggtcccccgcggtccctacgttccgtcccgttccccggccccttccgtacccgaaccgg

SEQ ID NO: 392662 - DNA, 576 bp, Homo sapiens
  misc_feature: GZ8MTXP02FMVQK.19.80.H03.1.454.CMB.2.raw
  modified_base (546)..(546): a, c, t, g, unknown or other
  modified_base (562)..(562): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaggtggtgtgacgacccctgaggagcgtggggccctcggtcccaggcagcgcgtcggccctgctgctgccgtggctggccagtcggtccgcccagtcggcctgctgccgcccgtaagtcggtgccaccggcgaaacgggccgggaacccacgaccccgtggacgcctacgagttaggagcgagccggaatccgagcccgtggccggacgccgtggcgggcagggccaacggcccaacgcccgtacgccccgtcggaaccncgtcctaccgtccccncctcctccgaacgg

SEQ ID NO: 392663 - DNA, 625 bp, Homo sapiens
  misc_feature: GZ8MTXP02FSMG4.19.80.H03.1.454.CMB.2.raw
  modified_base (222)..(222): a, c, t, g, unknown or other
  modified_base (275)..(275): a, c, t, g, unknown or other
  modified_base (298)..(298): a, c, t, g, unknown or other
  modified_base (379)..(379): a, c, t, g, unknown or other
  modified_base (384)..(384): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcgggccagaggtcgcccctgaacctgaaggccaatganacccaagacaggccaagtgggtngacgacccctgaggagcgtggggcccctggtccccaggcaggcgctcggccctgctgctgccgtggtctggccagtcggcncccgntcggcctgctgccgccctaagtggtcgccgacgcgaaacggcccggggacccacggaacccgtcggacgccgtacgacggttaggaaacgcgacggccgaatcccgagccgtcggacggcgccgtgggtcggggcgacgggtcgaccggcccgaaacggtccgtaccggccccgtaacggtccggtcccgtaaccgttcccgttacccggttccccctaacccccgttcccgtaaccccgg

SEQ ID NO: 392664 - DNA, 525 bp, Homo sapiens
  misc_feature: GZ8MTXP02GDRDD.19.80.H03.1.454.CMB.2.raw
  modified_base (435)..(435): a, c, t, g, unknown or other
  modified_base (458)..(458): a, c, t, g, unknown or other
  modified_base (464)..(464): a, c, t, g, unknown or other
  modified_base (469)..(469): a, c, t, g, unknown or other
  modified_base (476)..(476): a, c, t, g, unknown or other
  modified_base (480)..(480): a, c, t, g, unknown or other
  modified_base (493)..(493): a, c, t, g, unknown or other
  modified_base (503)..(503): a, c, t, g, unknown or other
  modified_base (515)..(515): a, c, t, g, unknown or other
  modified_base (521)..(521): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaaagtgggtgtgagacccctgaggagctgggccctggtcccaggcagcgctggcccctgctgctgcctggggtctgggccagtcggtcgcccatcggccctgcctgcgcccaaatgtgcaccgcaaagccggggacccagaccctggacnccgtcagttggaagcagccgacncagcgngcggngcgtggnggcnggcacgccagccncgccctcgcnctctccgtcccncctccncacg

SEQ ID NO: 392665 - DNA, 604 bp, Homo sapiens
  misc_feature: GZ8MTXP02I3L03.19.80.H03.1.454.CMB.2.raw
  modified_base (220)..(220): a, c, t, g, unknown or other
  modified_base (247)..(247): a, c, t, g, unknown or other
  modified_base (371)..(371): a, c, t, g, unknown or other
  modified_base (402)..(402): a, c, t, g, unknown or other
  modified_base (482)..(482): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtnccctgaacctgaaggccaatgagacccaagacaggccaaagtgggtgtgagacccctgaggagctgggccctggtcccaggcagcgctggcccctgctgctgcctgggctggcctagtcggtcnccgatcggcctgctcgacgcccaatggttcnccgaccgacgaaacgcgggggacccacggacccgtgggacgcctacgagttaggaacgcaacgccgaactcccgagtccnggacggcgccgtggtcggggacgacggcgacgaccccgaaggtccctaccggccccccgttacgggtccctaccgttccgtaccggttccccctaaccccggtcccttaccccgtaaaccgg

SEQ ID NO: 392666 - DNA, 592 bp, Homo sapiens
  misc_feature: GZ8MTXP02FZUHW.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtcgcccctgaacctgaaggccaatgagacccaagacaggccaagtgggtgtgagacccctgaggagcgtcgggccctggtcccaggcagccgctcggcccctgctgctgccgtgggtctggccagtcggcgcccgatcggcctgctgccgcccgagtggttcgcgaccgcgaaacggaccgggacccgacggacccgtggacgcctacgacgttggaacgcgacgaccgaagtcccgacgccgtggacggcggccggtgggtggggacgagggtccgacgcccgaacggcccgtcggccccctcggtcctaccgtccgttcccgttccccaccctccctccgaaccg

SEQ ID NO: 392667 - DNA, 588 bp, Homo sapiens
  misc_feature: GZ8MTXP02JYSS8.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggccagaggtgcccctgaacctgaaggccaatgagacccaagacaggccaagtgggtgtgagacccctgaggagctgggccctggtcccaggcagcgctcggccctgctgctgcctgggtctggccagtcggtcgcccgagtcggcctgcctgccgcccaagtcggttcgcgaccgcgaaacggcggggaccccacggacccgtagggacgccgtcgacgttgggaagcgagccgatccgagccgtggcggagtccgtggtcggggcgacgggtcacggcccgaaaggcctccggccccctcgggtaacctccgtccgtccggttccccgtccctcccgtaccgaacccgg

SEQ ID NO: 392668 - DNA, 610 bp, Homo sapiens
  misc_feature: GZ8MTXP02I3IKI.19.80.H03.1.454.CMB.2.raw
  modified_base (370)..(370): a, c, t, g, unknown or other
  modified_base (375)..(375): a, c, t, g, unknown or other
  modified_base (399)..(399): a, c, t, g, unknown or other
  modified_base (492)..(492): a, c, t, g, unknown or other
tcagtactctcgtgcacgaccggtgctcgatttagctgtgcgtcgaagggaaaggggccctctgggagagatccccaggggtgacagccatggatcctggaagggcctgggctagggacagggaccagagccagtccagggagaggacagatccaatggactggggtgtactgtaacagccctgctggcgagagggaccagggcaccgtcctccgagggagcccatgctgcaaggtcgggccaggaggtcgcccctgaaccctgaacggccaatgagacccaagacaggccaagtgggtgtgacgacccctgaggagcgtgggccctggtccccaggcagcgctcggccccctgctgctcgcgtgggtcnggccngtcggtcgccagtcgcctgctgcnccagtgtgcaccgacgaaacggccggggaacccaggaccccgtggacgccgtcgaggttacgggaagccgacggcccgagtccgacgtcccgnggccggacggcccgttgggtcgggggcgtacgggtccgacggcccgaaacgggcccgttccggcccccgtcgggtcctaccgtcctccggtttacccccgcccgttaccccgtcccgg

SEQ ID NO: 392669 - DNA, 569 bp, Homo sapiens
  misc_feature: GZ8MTXP02GMTKM.19.80.H03.1.454.CMB.2.raw
  modified_base (220)..(220): a, c, t, g, unknown or other
  modified_base (263)..(263): a, c, t, g, unknown or other
  modified_base (286)..(286): a, c, t, g, unknown or other
  modified_base (300)..(300): a, c, t, g, unknown or other
  modified_base (361)..(361): a, c, t, g, unknown or other
  modified_base (462)..(462): a, c, t, g, unknown or other
  modified_base (472)..(472): a, c, t, g, unknown or other
  modified_base (476)..(476): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggcagagtgccctgacctgaagccaangagaccaagacagccaagtggtngagcccctgagganctggggccctggtcccaggcagcgctcggcccctgctgctgcctggtctgccagtcggtcncccgagtcggctgctgccgcccagtcggtgcgaccgacgaaacggccgggaacccaggaaccccgtgggacgcctacgaaggttcggaacgcgacgccganccgagcccgngcgngcgtgggcggacgacggcgacgacccgacgccgtcccgtccccgtcggcctaccgtcccgttacccgttccccctacccgttcccaccgtacg

SEQ ID NO: 392670 - DNA, 636 bp, Homo sapiens
  misc_feature: GZ8MTXP02JU3BO.19.80.H03.1.454.CMB.2.raw
  modified_base (224)..(224): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccagggccaccgtcctccgagggacncccatgctgcaagtcgggccaggaggtcgcccctgaacctgaacggccaatgagacccaagacaggccaagtgggtgtgagaccccctgaggagctgggccctggtcccaggcagcgctcggccctgctgctgcctgggtctggccagtcggtccgcccacgtcggccttcgcgtcgccgcccctaagtcggttcgccgacccgcgaaacggcgggggaccccacggacccgtgggaccgccgtacgagttacgggacgcgacgcccgaacgtcccacgccctggccggacgccgtgggtcggggccgtacggtcgacggacccgaaacgggcccgtaccggcccccgtcggtcccgtaccgttcccgttcccggttcccccgtcccccgttacccctacccgaaacccggg

SEQ ID NO: 392671 - DNA, 640 bp, Homo sapiens
  misc_feature: GZ8MTXP02F9QT2.19.80.H03.1.454.CMB.2.raw
  modified_base (205)..(205): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcnccgtcctccagggagcccatgctgcaagtcggcagagtgccctgaacctgaagccaatgagacccaagacaggccaagtggtgtgagacccctgaggagcgtgggccctggtcccgaggcgacgcgcgtcggcccctgctgctgcctggtcctggccagtcggtcgccctagtcggccgtgcctcgccgtaccccgtaatcggttcgccgaaccgacgaaaacgggccggggaaccccaggacccccgtagggacgcccgtacgtaacggttcgggaaacgccgacgacccgaacgtcccgacggcccgtggaccggacgccgtgggtcggggcgacgggtccgaacggacccgaaacggtcccgtccggcccccgttacgggccctaccgtcccgttcccgttcccccacccccgttccctacccgtaacccgg

SEQ ID NO: 392672 - DNA, 582 bp, Homo sapiens
  misc_feature: GZ8MTXP02FR0T5.19.80.H03.1.454.CMB.2.raw
  modified_base (243)..(243): a, c, t, g, unknown or other
  modified_base (489)..(489): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagnggtgcccctgaacctgaaggccaatgagacccaagacaggccaagtgggtgtgagacccctgaggagctgggccctggtcccaggcagcgctggcccctgctgctgccgtggggtctggccagtcggtcgcccgatcggcctgctcgccgcccaagtgttcgcaccgcaaacgcgggacccagacccgtggacgctcgagtggagcgagccgatccgagccgtggcggagccgtggtcggggacgngggtcacggcccgaaacgggccctccggccccccgtcgggtaaccctccgtccgttcccggttcccccgtccccgtccctacccgtaacccgg

SEQ ID NO: 392673 - DNA, 603 bp, Homo sapiens
  misc_feature: GZ8MTXP02IA8P2.19.80.H03.1.454.CMB.2.raw
  modified_base (220)..(220): a, c, t, g, unknown or other
  modified_base (271)..(271): a, c, t, g, unknown or other
  modified_base (292)..(292): a, c, t, g, unknown or other
  modified_base (306)..(306): a, c, t, g, unknown or other
  modified_base (403)..(403): a, c, t, g, unknown or other
  modified_base (434)..(434): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaaggtcggccagaggtcgcccctgaacctgaagccaatganaccagacaggccaagtgggtngacgaccctgaggncgtgggccctggcccaggcagccgctcggccctgctgctgcctgggtctcggcctagtcggccgcccagtcggccctgctcggccacccagtggtcncgaccgacgaacggccgggaccacgacccgnggacgcgtacgtaggtacggaacgcgacgaccgactccgacgcccgcggccggacgtcccgtgggtcggggacgacgggtccgacgcccggaacggtcccgtccgtcccccgtcgggtcccaccgttcccgtcccgtttacccccctccccgttacccgtacccgaccg

SEQ ID NO: 392674 - DNA, 709 bp, Homo sapiens
  misc_feature: GZ8MTXP02F28CL.19.80.H03.1.454.CMB.2.raw
  modified_base (220)..(220): a, c, t, g, unknown or other
  modified_base (244)..(244): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggganccatgctgcaagtcggcagaggtnccctgaacctgaaggccaatgagacccaagacaggccaagtgggtgtgagacccctgaggagctgggccctggtcccaggcagcgctggcccctgctgctgcctgggtctggccatcggtcgcccatcggcctgccgtgccgccccgaaagttcggttacgccgaacccgacgaaaacgggcccgggggaacccccaacggaacccccgtgggaaaccgcccgttaccgaacggtttcgggaaaacgccgaacggcccggaaacgttacccccgaaggccccgttacggggcccgggaacggtccccgtttaggggtcggggggaccctagggggttacccgaacgggacccccgaaaacggggccccgtaccggtccccccccgtaacggggttccctaaccccgttcccgttaccggtttcccccccggtccccctcccccgtttacccccgtaaacccgggg

SEQ ID NO: 392675 - DNA, 594 bp, Homo sapiens
  misc_feature: GZ8MTXP02F0DR2.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagagtgccctgaacctgaaggccaatgagacccaagacaggccaagtgggtgtgagacccctgaggagctgggccctggtcccaggcagcgctggccctgctgctgcctgggtctggccagtcggtcgcccgatcggcccttgcctcgccgccccgtaaatcgggttcgccgaccggacgaaacggccgggggaccccaacggacccgtggacgccgtcgacgttggaaacgcgacggaccgactcccgaggccctcggcggacgcccgtggtcggggcgacgggtcgaacggtcccgaacggccgtcgcccccgtggtccaccgtcgttccgtccccgccctcccgtccaaccgg

SEQ ID NO: 392676 - DNA, 629 bp, Homo sapiens
  misc_feature: GZ8MTXP02I86WP.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcggcagaggtgcccctgaacctgaaggccaatgagacccaagacaggccaagtggtgtgagacccctgaggagcgtgggccctggtcccaggcagcgctcggccctgctgctgcctgggtctggccagtcggtccgcccgagtcggccctgccgtcgccgccctaagtcggttcgccgaccggacgaaacggacgggacccacggacccgtggacgccgtacgaggttacggaacgccgagcccgaagtcccgacggtcccgaggccggtacgccggtcgggcgggggcgacgggtccgacggaccccgaacgggcccgtaccggcccccgtacgggtcctacccgttccgtcccggttcccccggtcccctttaccccgtacccgtaacccgg

SEQ ID NO: 392677 - DNA, 658 bp, Homo sapiens
  misc_feature: GZ8MTXP02GG4QI.19.80.H03.1.454.CMB.2.raw
  modified_base (223)..(223): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacncccatgctgcaagtcgggcagagtgccctgaacctgaagccaatgagaccaagacaggccaaagtgggtgtgagacccctgaggagctgggccctggtcccaggcagcgctcggcccctgctgctgcctggggtctggccagtcggtacgcccagtcggcctgcctgccgccccaaagtcggttcgcgaccgcgaaaacggccggggaccccacggaccccgtgggaacgccgttacgaagttcgggaaacgcgaggcccgatcccgacggccctggaccgggacgcccgtggggtcgggggaccgtacggggtaccgacggacccccgaaacggggtcccttacccggccccccgttaccggggtccctaacccgttcccgttacccggtttccccccaaaccccgtttcccccgtaccccgtaaaaccccggg

SEQ ID NO: 392678 - DNA, 682 bp, Homo sapiens
  misc_feature: GZ8MTXP02I75W1.19.80.H03.1.454.CMB.2.raw
  modified_base (168)..(168): a, c, t, g, unknown or other
  modified_base (220)..(220): a, c, t, g, unknown or other
  modified_base (290)..(290): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaagtcggccagaggtcgcccctgaacctgaagccaatgagaccagacaggccaagtggtntgagaccctgagagcgtgggccctggtcccaggcagcgctcggcccctgctgctgcctggctggcctagtcgtcgccgagtcggcctgctacgccgaccctagtcggtcgcgaccgacgaacggccgggacccaacgcccgtaggacgaccgtggtaacggtacgggaacgtccgaacggccgtaaactcccgaacggtccgtacggggacgggtacggtccggtcggggttacggggaccggtaacgggttccggaccggttaccccggtaaacggggccccttacccgggaaccccccggtttcgggtaaccccttaacccggtttccccggttcccggttttcccccccgaacccccggtttcccccgtttaaccccggaaacccgggg

SEQ ID NO: 392679 - DNA, 597 bp, Homo sapiens
  misc_feature: GZ8MTXP02IKG37.19.80.H03.1.454.CMB.2.raw
  modified_base (366)..(366): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtgccctgaacctgaagccaatgagaccaagacaggcaaagtggtgtgagacccctgaggagctgggccctggtcccaggcagcgctggcccctgctgctgcctggggtctggccagtggtcnccgatggccctgctgcgcccaatgtgcacgcaaacgcgggacccaagccctaggacgcctacgagttaggaagcgaggacccgatcccgaagcccgtggcggaagaccgtggtcggggaccaggggtaccacggaccccgaaaacggcccgtaaccggtcccccgttacggggcctaacccgttcctttccggtttaccccccaacccgtttcccctaccccgtaaaccgg

SEQ ID NO: 392680 - DNA, 616 bp, Homo sapiens
  misc_feature: GZ8MTXP02JS421.19.80.H03.1.454.CMB.2.raw
  modified_base (168)..(168): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacgcccatgctgcaagtcgggccagaggtgcccctgaacctgaaggccaatgagacccaagacaggaccaagtgggtgtgagacccctgaggagctgggccctggcccaggcagcgctggccctgctgctgcctgggtctggccagtcggtcgccctagtcggcccttgccgtcggccgcccgaagtcggttcgcccacggacgaaacggccggggacccacggacccgtggacgccgtacgacggttacggaacgcgaacgccggactccgacgccgtaggccggacgtccgtggcggggactagggtccacggaccccggaacggccgtccggcccccgtggaaccctccgttcccgtaccggttcccccaccccgttcccgacccgtaacccgg

SEQ ID NO: 392681 - DNA, 584 bp, Homo sapiens
  misc_feature: GZ8MTXP02IR4HG.19.80.H03.1.454.CMB.2.raw
  modified_base (247)..(247): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggcagaggtnccctgacctgaaggccaatgagacccaagacaggccaagtgggttgtgacgacccctgaggagcgtgggccctggtcccaggcagcgctggccctgctgctgcctgggtctcggcctagtcggtcgccgatcggcctgctgcgcccagtgtgcaccgcgaaacgcgggacccacggacccgtgggacgccgtcgaggttcggaacgcgacgccgacgtcccgacgccgtggcggacgccgtgggcggggtcacgggtcacggacccgaacggcccgtccgcccccgttcggtcctaccgttccgtccgttccccgccccgttcccgtacccaaccgg

SEQ ID NO: 392682 - DNA, 576 bp, Homo sapiens
  misc_feature: GZ8MTXP02IO34S.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtggtgtgagacccctgaggagctgggccctggtcccaggcagcgctcggcccctgctgctgcctgggtctggccagtcggtcgcccagtcggcctgcctcgccgcccaagtcgttcgcaccgcgaaacggcgggacccacggacccgcggacgccgtcgacggttggaacgcgacgaccgaactccgacgtccgcggcggacgccgtggtcgggcgacggtcgacgaccgaacgccgtccgccccgtcggtaacctccgtccgtcgttcccgaccctccgtaccaccg

SEQ ID NO: 392683 - DNA, 656 bp, Homo sapiens
  misc_feature: GZ8MTXP02F5I1H.19.80.H03.1.454.CMB.2.raw
  modified_base (222)..(222): a, c, t, g, unknown or other
tcagtactctcgtgcacgaccggtgctcgatttagctgtgcgtcgaagggaaaggggccctctgggagagatccccaggggtgacagccatggaccctggaagggcctgggctagtaacagggaccagagccagtccagggagaggacagagccaatggactggggtgtactgtaacagccctgctggcgagagggaccagggcaccgtcctccgagggacnccatgctgcaagtcgggcagaggtcgcccctgaacctgaacggccaatgagaccaagacaggccaagtgggtgtgagacccctgaggagctgggccctggtcccaggcagcgctcggcccctgctgctgcctgggtctggcagtcggtcgccgatcgggccttgccgtcgccgaccctaagtcgggttcgccgaaccggaccgaaaacgggcccgggggaaccccaacggaccccgtagggacgccgtacgaggttacggaaacgccgacgaccgagtacccgaggtccgacggcggacgccgttgggcggggacgtacgggaccgaaccgggcccgaaacgggtcccgttccggccccccgtttcgggaaccctaacccggttcccttcccggtttaccccctacccctttcccccgtacccgtaaacccggg

SEQ ID NO: 392684 - DNA, 620 bp, Homo sapiens
  misc_feature: GZ8MTXP02GS1YC.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggcagaggtcgcccctgaacctgaaggccaatgagacccaagacaggccaagtggtgtgacgacccctgaggagcgtcgggccctcggtcccaggcacggccgcgtcggcccctgctgctgccgtgggtctggcagtcggtcgccgagtcggcctgctcgccgccctaagtcgttcgaccgaccgacgaaacggccgggaacccacggacccgtcggacgccgtacgacgttacggaacgcgacgaccgactcccgacgccgtacggacggacgtccggtgggtcggggacgacgggtcgaacggacccgaacggtcccgtccggcccccgtcggtcccgtacgttcccgtccgttcccccgccccttcccgttaccgaacccgg

SEQ ID NO: 392685 - DNA, 575 bp, Homo sapiens
  misc_feature: GZ8MTXP02HHJJD.19.80.H03.1.454.CMB.2.raw
  modified_base (169)..(169): a, c, t, g, unknown or other
  modified_base (223)..(223): a, c, t, g, unknown or other
  modified_base (295)..(295): a, c, t, g, unknown or other
  modified_base (357)..(357): a, c, t, g, unknown or other
  modified_base (553)..(553): a, c, t, g, unknown or other
tcagtactctcgtgcacgaccggtgctcgatttagctgtgcgtcgaaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaagtcgggcagaggtcgcccctgaacctgaagccaatgagacccaagacaggccaagtggtntgagcccctgaggagctgggccctggtcccaggcagcgctcggccctgctgctgcctggtcngcagtcgtcgccagtcggcctgctgccgcccagtcggtcgcacgacgaaacggccgggacccacgacccgtggacgccgtacgtagtaggacgcgacgccgaactccgacgccgtgcggacgccgtggtcgggcgacggtccgacgaccgaacgccgtaccgcccccgtcgtccgaccgtccgttcccgtaccccnccccttaccctaccgaacccgg

SEQ ID NO: 392686 - DNA, 544 bp, Homo sapiens
  misc_feature: GZ8MTXP02H98N4.19.80.H03.1.454.CMB.2.raw
  modified_base (246)..(246): a, c, t, g, unknown or other
  modified_base (398)..(398): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagaggtnccctgaacctgaaggccaatgagacccaagacaggccaagtgggttgtgacgacccctgaggagcgtgggccctggtccccaggcagcgctggcccctgctgctgcctgggtctggccagtcggcgcccatcggcctgctgcgccatggttncacgcgaaacgcgggacccagaccctggacgctcgagttgacgcacgccgatccgagccgtgccggagccgtgcggggcagggtcacggcccgaacggcctacggccccctggtccaccgtctccgtccccaccctcctaccgacg

SEQ ID NO: 392687 - DNA, 623 bp, Homo sapiens
  misc_feature: GZ8MTXP02H7YEI.19.80.H03.1.454.CMB.2.raw
  modified_base (370)..(370): a, c, t, g, unknown or other
  modified_base (404)..(404): a, c, t, g, unknown or other
  modified_base (595)..(595): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgacctgaaggccaatgagacccaagacaggccaagtgggtgtgagacccctgaggagctgggccctggtcccaggcagcgctggcccctgctgctgcctgggtctggccagtcggtcncccgattcggcccttgcctgcgcccaatcggtcnccaccggcgaaaacggccggggacccacgacccgtggacgccgtcgacggttaggaacgccgagcccgaactcccgaacgcccgtggccggagcccgtgggtcgggggccgagggtccgacggaccccgaaacgggcccgtccggtccccccgttcgggtccctacccgttcccgttcccggttacccccncccccgttacccttaccccgtaacccgg

SEQ ID NO: 392688 - DNA, 618 bp, Homo sapiens
  misc_feature: GZ8MTXP02GK4Q6.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggancccatgctgcaagtcgggccagaggtgcccctgaacctgaaggccaatgagacccaagacaggccaagtgggttgtgacgacccctgaggagctgggccctggtcccaggcagcgctcggcccctgctgctgcctgggtctggcctagtcggtccgccccgtagtcggtccctgctacggccgcccctaagttcggtcgccaaccgacgaaacggccggggacccacggaccccgtgggaccgccgtacgacggttacggaaacgccgacgcccggactcccgagcccgtggcggacgccgtgggtcggggcacgggtcgacggacccaacgggcctccgcccccgttcggtccctaccgttccgtcccgttcccccacccgtccctaccgaaccgg

SEQ ID NO: 392689 - DNA, 651 bp, Homo sapiens
  misc_feature: GZ8MTXP02GYPGL.19.80.H03.1.454.CMB.2.raw
  modified_base (168)..(168): a, c, t, g, unknown or other
  modified_base (222)..(222): a, c, t, g, unknown or other
  modified_base (379)..(379): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaaggtcgggccaggaggtcgcccctgaacctggaacggccaatgagaccaagacaggccaagtggtgtgacgacccctgacggagcgtgggccccgtggtcccgaggcaggccgctcggcccctgctgctgccgtgggtctggaccngtcggtccgccgagtcggcctgcctcggccgacccgtagttcggttcgctacgtcgacgaaacggcccgggggaaccctacggacccgtgggaccgtccgtacggtaggttcgggaacggccgaggacccgaacgcccgtacggcccgtcgggaccgggtacgtcccgtggggtcgggggccgagggtacccgacggaccccgtaacgggcccgtccggtcccccgtcggtccctccgttccgtccgttcccccgcccttacccgtacccgg

SEQ ID NO: 392690 - DNA, 616 bp, Homo sapiens
  misc_feature: GZ8MTXP02FYRWU.19.80.H03.1.454.CMB.2.raw
  modified_base (212)..(212): a, c, t, g, unknown or other
  modified_base (220)..(220): a, c, t, g, unknown or other
  modified_base (246)..(246): a, c, t, g, unknown or other
  modified_base (356)..(356): a, c, t, g, unknown or other
  modified_base (374)..(374): a, c, t, g, unknown or other
  modified_base (472)..(472): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtccncagggacncccatgctgcaagtcggcagaggtcnccctgaacctgaagccaatgagaccaagacaggccaagtgggtgtgagacccctgaggagcgtgggccctggtcccaggcagcgctcggccctgcgtgctgcctgggtcnggccagtcgtcgcccgancggctgctgccgcctaagtcggtcgcaccgacgaaacgccggggacccacggacccgtcggacgcccgtagaggttagggaacgcgacggcccgtaancccgacgccgtcggccgggacgtccggtgggtcgggggacagggtccgacggacccgaacggtccctacccggtcccccgtaccgggtcccaccgttcccgtcccggttcccccggtccccctcccgttacccgtaaacccggg

SEQ ID NO: 392691 - DNA, 601 bp, Homo sapiens
  misc_feature: GZ8MTXP02GCVFL.19.80.H03.1.454.CMB.2.raw
  modified_base (245)..(245): a, c, t, g, unknown or other
  modified_base (306)..(306): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggtcagagccaatggactggggtgtactgtaacagccctgctggcgagagggaccagggcaccgtcctccagggagcccatgctgcaagtcggcagaggtnccctgaacctgaaggccaatgagacccaagacaggccaagtgggtgtgagacccctgaggngctgggccctggtcccaggcagcgctcggcccctgctgctgcctggtctggccagtcggtcgcccagtcggcctgctcgacgcccaagtggttcgcaccggcaaaggccggggacccacggacccgtgggacgccgtacgacgttgggaacgccgagccgatcccgagtcccggcggccggacgccgtgggtcgggcgacgggtcgacggacccgacggtcccgtcccggtcccccgtacggtcccgtaccgttcccgttcccgttaccccctaccccgtcccgtacccgtacgg

SEQ ID NO: 392692 - DNA, 655 bp, Homo sapiens
  misc_feature: GZ8MTXP02JDRMN.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggcagaggtcgcccctgaacctgaacggccaatgagacccaagacaggccaaggtgggttgtgacgacccctgaggagcgtgggccctggcccaggcagcgcgtcggccctgctgctgccgtgggtctcggcctagtcggtccgccagtcggcctgccgtcgccgccgtaagttcggtacgcgaaccgacgaaacgggccgggaacccgacggacccgtacggacgccgtacgacggtaggaacgccgaacggcccgacgtccgacgtcccgtaggaccggtcggtcccggttgggccggggaccgtacgggaccgaccggacccgaacgggtcccgtacccggcccccgttacggtaacccgtacccgttcccgttacccgttaccccctacccccttacccgacccgtaaacccgg

SEQ ID NO: 392693 - DNA, 674 bp, Homo sapiens
  misc_feature: GZ8MTXP02HRWJG.19.80.H03.1.454.CMB.2.raw
  modified_base (222)..(222): a, c, t, g, unknown or other
  modified_base (310)..(310): a, c, t, g, unknown or other
  modified_base (545)..(545): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacncccatgctgcaaggtcggccaggaggtcgcccctagaacctggaacggccaagtcgaacgaacccaagaccaggccaaaggtgggttngacgaccccgtgaggacgcgtcgggccctggcccaggcaggccgcgtcggccctgctgctggccgtggggtcaggcctagttccggccgcccgtagttcggccctgaccgtcgacccgtaccctaagttcgggtaccgacccgaaccggaaccggaaaaccggggcccggggaacccgaaccgtaccccggtacggaccgtcccgtagtacggttaggaacgcgacggaccgacnccgacgccgtaggccggtcgccgtgggacggcgacgggtccgaacgccggaaacggtcccgccggtacccccgttcggaacccttccgtccctttccgtaccccctaccccgtccgtaccccgaaccgg

SEQ ID NO: 392694 - DNA, 649 bp, Homo sapiens
  misc_feature: GZ8MTXP02F5UE7.19.80.H03.1.454.CMB.2.raw
  modified_base (294)..(294): a, c, t, g, unknown or other
  modified_base (491)..(491): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtngagacccctgaggagctggggccctggtccccaggcaggcgctggcccctgctgcctgcctgggtctggccatcggtcgcccgatcgggccctggcctgccgccctaatgggttcgccgaaccgcaaaacggccgggggaccccaggaacccccgtgggacgcctaccgaggttcgggaaacgcgagcccggtaacnccgacgccgtacggccggacgtccgtgggtcggggacgtacgggtccgaaccggtacccgaaacgggtcccgtcccggtacccccccgttacgggtaaccctacccgttcccgttacccggtttaccccccacccccgtttccccgtacccgaaccgg

SEQ ID NO: 392695 - DNA, 579 bp, Homo sapiens
  misc_feature: GZ8MTXP02F4BUY.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaaagtgggttgtgagaccccctgaggagctgggccctggtcccaggcagcgctggcccctgctgctgcctgggtcctggccatggtccgccgagtcggcctgcctgccgcccaagtcgttacgcaccgcgaaacgcggggacccagaccctggacgcctacgagttcggaagcgagccgactcccagcctgacggtgccgtggtcggggcacgggtcacggcccgaacgggcctcggcccccgtcggtaacccgtcgtcccgtccgttccccggcccttcccgaccgtaacccgg

SEQ ID NO: 392696 - DNA, 477 bp, Homo sapiens
  misc_feature: GZ8MTXP02IM28A.19.80.H03.1.454.CMB.2.raw
  modified_base (247)..(247): a, c, t, g, unknown or other
  modified_base (443)..(443): a, c, t, g, unknown or other
  modified_base (468)..(468): a, c, t, g, unknown or other
  modified_base (471)..(477): a, c, t, g, unknown or other
tcagtactctcgtgcacgaccggtgctcgatttagctgtgcgtcgaagggaaaggggctggagtgggtggccaacataaagccagatggaagtgagagatcttatgtggactctgtgaagggccgattcagcatctccagagacaacgccaagaattcactgtttctgacaaaataaacagcctgagagccgaggacacggctgtctaactattgtgtgagagagataagaattactttgatttcgnggggccaggggacaacggtcaccgtctcttcacgccctaccaaccgaaacgggccccaagtccggtcccttccccccgtggcccgcccctgcctaccgaaggacgccaccctccggaagacgccaacgacggccggcccctgggctgcccttgggcaaaggtaccctaccttacccccgaacggagacgttaccgngacggcggctggacgaagacgacanagnnnnnnn

SEQ ID NO: 392697 - DNA, 600 bp, Homo sapiens
  misc_feature: GZ8MTXP02GWZKG.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggccagaggtcgcccctgaacctgaaggccaatgagacccaagacaggccaagtgggttgtgagacccctgaggagctgggccctggtcccaggcagcgctcggcccctgctgctgcctgggtctggcctagtcggtcgcccgagtcggcctgctcgccgcccgagtcggtcgcgaccgcgaaacggcggggaccctacggaccctggacgcctacgagttggaagcagccgatcccgagccgacgcggacgccgtgggtcggggcgtagggtccgacggccccgaaggcccgtccggtccccccgtacggtccaccgttccgttacccggttaccccctacccgttccccgtacccgtaaccgg

SEQ ID NO: 392698 - DNA, 620 bp, Homo sapiens
  misc_feature: GZ8MTXP02JABFT.19.80.H03.1.454.CMB.2.raw
  modified_base (220)..(220): a, c, t, g, unknown or other
  modified_base (375)..(375): a, c, t, g, unknown or other
  modified_base (482)..(482): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggacncccatgctgcaagtcgggccagaggtcgcccctgaacctgaaggccaatgagacccaagacaggccaagtggtgtgagacccctgaggagctgggccctggtcccaggcaggcgcgtcggccctgctgctgccgtgggtctaggccagtcggtcncccgagtcggcctgccgtacgcgccctaagtcggttacgcgacgcgaaacggccgggacccacggacccgtcggacgccgtcgacggttaggacgcgacgccgaacncccgaaggccgttaggccgggacgtccggtaggcggggacgacgggtcacggcccgaaacggccgtccggtcccccgtcggtcccaccgttcccgttacccggttcccctaacccccggtttcctacccgaaacccgg

SEQ ID NO: 392699 - DNA, 696 bp, Homo sapiens
  misc_feature: GZ8MTXP02ISUXP.19.80.H03.1.454.CMB.2.raw
  modified_base (222)..(222): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctcgagggacncccatgctgcaagtcgggcaggaggtcgcccctgaacctgaacggccaagtgacgacccaagacaggaccaagtgggtgtgacgaccccgtgaggagcgtcggggccctggtccccaggcagcgcgtcggcccctgctgctggcccgtgggtctggcctagtcggtccgcctgtcggcctgccgtcgccgacctaagtcggttcgcgaccggacgaaaccgggccggggaacccacgggacccgtacgggaccgccgtacgtaacggttaccgaaacgccgacggcccgtaacgtccccgacgcccgtcggaccgggacgtccgggtacggggtcggggaccgtacgggccgaaacccgggaccccgtaacggggtccccgtccccgggtaccccccgttccgggtaacccgtacccgttccccggttccccgttacccccctacccccgtttacccgacccggtaaacccggg

SEQ ID NO: 392700 - DNA, 585 bp, Homo sapiens
  misc_feature: GZ8MTXP02G3FB1.19.80.H03.1.454.CMB.2.raw
  modified_base (495)..(495): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcgggcagaggtgcccctgaacctgaaggccaatgagacccaagacaggccaagtgggtgtgagacccctgaggagcgtgggccctggtcccaggcagcgctcggccctgctgctgcctgggtctggccagtcggtcgcccagtcggcctgcgtgccgcccaagtggttcgcaccgacaaacggccgggacccacgacccgtggacgccgtcgaggttcgaagccaggccgaactcccgacgcctggacggcgccgttggnggggcacgggtccacgggccaacggccttaccgcccccgtacggtcctaccgttccgtccgtttccccaccccgtttcccgccgaaccgg

SEQ ID NO: 392701 - DNA, 578 bp, Homo sapiens
  misc_feature: GZ8MTXP02GGAWN.19.80.H03.1.454.CMB.2.raw
  modified_base (168)..(168): a, c, t, g, unknown or other
  modified_base (219)..(219): a, c, t, g, unknown or other
  modified_base (244)..(244): a, c, t, g, unknown or other
  modified_base (463)..(463): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagaggaccagggcaccgtcctccagggancccatgctgcaagtcggccagagtnccctgaacctgaagccaatgagacccaagacaggccaagtgggttgtgacgacccctgaggagctgggccctggtcccaggcagcgcgtcgccctgctgctgcctgggtctggccagtcggtcgcccatcggcctgctcgccgcccaagtcgtgccgaccgacgaaacggccgggacccacggacccgtggacgccgtcgagtggaacgcgacgccganccgacgcctggcggacgccgtggtcgggcgacggcgacgacccgaacggtcccgtccgcccccgttcggtcctccttccgtccggttcccccgtccctacccgtacccgaaccgg

SEQ ID NO: 392702 - DNA, 614 bp, Homo sapiens
  misc_feature: GZ8MTXP02IT6PM.19.80.H03.1.454.CMB.2.raw
  modified_base (168)..(168): a, c, t, g, unknown or other
  modified_base (222)..(222): a, c, t, g, unknown or other
  modified_base (371)..(371): a, c, t, g, unknown or other
  modified_base (383)..(383): a, c, t, g, unknown or other
  modified_base (400)..(400): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaagtcgggccaggaggtcgcccctagaacctgaacggccaagtgagacccaagacaggccaagtgggttgtgagacccctgaggagcgtgggccctggtcccaggcagcgctcggccctgcctgctgcctggtctgacngtccgtcgccgntcggctgccgtacgacnccgtagtcgtacgcgaccggacgaaacggccgggacccgtacggacccgtcgacgaccgtacgaggttacggaacgcgacgtccgacgccgcgccgaggccggacgccgtcgggacgggtcgacgggccgacggacccgaacggtccctcccggtccccgtacgtccgtcccgttcccgtcccgttacccccgcccttcccgtaccgtaaccgg

SEQ ID NO: 392703 - DNA, 628 bp, Homo sapiens
  misc_feature: GZ8MTXP02JTQTX.19.80.H03.1.454.CMB.2.raw
  modified_base (221)..(221): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaagtcgggccaggaggtcgcccctgaacctgaacggccaatgagacccaagacaggccaagtggtgtgacgaccccgtgaggagctgggccctggtcccaggcaggcgcgtcggcccctgctgctgcccgtggtctggccagtcggccgccgagtcggcctgctcgccgaccctagtcgtcgcgaccgacgaaacggccggacccacgacccgtgacgccgtacgagtcggaacgcacgccgactccgacggccgtcggacggacgccgtgggtacggggccgtaacggggtccgaaccgggcccggaacggtcccgtcccggtccccccgttacggtcccgtacccggttcccttcccggttaccccctaccccgttaccccgtacccgaacccgg

SEQ ID NO: 392704 - DNA, 706 bp, Homo sapiens
  misc_feature: GZ8MTXP02HJPXV.19.80.H03.1.454.CMB.2.raw
  modified_base (168)..(168): a, c, t, g, unknown or other
  modified_base (220)..(220): a, c, t, g, unknown or other
  modified_base (272)..(272): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcgagggancccatgctgcaaggtcggcagaggtcgcccctgaacctgaacggccaatganaccaagacagccaagtggtgtgagacccctgaggagcgtgggccctggccaggcagcgctcggccctgctgctggccgtcgggtctacggctagtcggtccgccgtagtcggccttgcctacggccgtcccaagttcggttacgccgaccgacgaaacgggcccgggtaacccacggaccccgtggaccgtaccgtcgaaggttcgaacggtacacgggtacccgtaaagcccgaacgtaccggtacgggaccgggttaccgacccgggtttggggccgggggtaccgtaaacgggggtcccgaaccggggacccggtttaaaccgggacccggtttcccccgggacccccgtttacggggtccctaaccggtttcccggtccccggttttaccccccggaaccccttccccggtttacccgtaaaccccgggg

SEQ ID NO: 392705 - DNA, 613 bp, Homo sapiens
  misc_feature: GZ8MTXP02HBL7W.19.80.H03.1.454.CMB.2.raw
  modified_base (222)..(222): a, c, t, g, unknown or other
  modified_base (521)..(521): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcgggccagaggtgccctgaacctgaaggccaatgagacccaagacaggccaaagtgggttgtgagacccccgtgaggagctggggccctggtcccaggcacgcgctggcccctgctgctgccgtgggtctggacctgtcggtccgcccgatcgggccttcgccgtcgccgcccgtaagtcggttcgccgaccgacgaaacggccgggaaccccgacggaccccgtggacgcctacgacgttacggagcgacgccgaactcccgacgccgtggccgagccgtcggnggggacgacgggcacggcccgaaacggccgtcccgcccccgttcgtcccgtccgttccgtccgttcccccgcccttcccgaccgtaacccgg

SEQ ID NO: 392706 - DNA, 535 bp, Homo sapiens
  misc_feature: GZ8MTXP02F8MK3.19.80.H03.1.454.CMB.2.raw
  modified_base (243)..(243): a, c, t, g, unknown or other
  modified_base (246)..(246): a, c, t, g, unknown or other
  modified_base (262)..(262): a, c, t, g, unknown or other
  modified_base (265)..(265): a, c, t, g, unknown or other
  modified_base (284)..(284): a, c, t, g, unknown or other
  modified_base (297)..(297): a, c, t, g, unknown or other
  modified_base (318)..(318): a, c, t, g, unknown or other
  modified_base (361)..(361): a, c, t, g, unknown or other
  modified_base (366)..(366): a, c, t, g, unknown or other
  modified_base (456)..(456): a, c, t, g, unknown or other
  modified_base (460)..(460): a, c, t, g, unknown or other
  modified_base (467)..(467): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacgcccatgctgcaagtcggcagngtnccctgacctgaagcanganaccaagcagcaagtggtgngacgccctgaggncgtgggccctggtcccaggcngcgcgtcggccctgcctgctgccgtggtctggccagtcggtcncccgngtcggcctgcctcggccgccgtagtcggtcgacaccgcgaaacggccgggacccacgccgtgacgctacgagtggagcacgcatccagcngcgngcgtggnggcgagcacgccacgcctacgccctcggtcctaccgtcgtaccgtcccctacctcccgtacgtaaccg

SEQ ID NO: 392707 - DNA, 659 bp, Homo sapiens
  misc_feature: GZ8MTXP02HOD3P.19.80.H03.1.454.CMB.2.raw
  modified_base (305)..(305): a, c, t, g, unknown or other
  modified_base (525)..(525): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcggcaggaggtcgccctagaacctggaacggcaagtgacgaacccaagacaggaccaaggtgggttgngacgacccctgaggagcgtcgggccctggcccgaggcgagcgcgtcggccctgctgcgtgccgtgggtctggcctagtcggtccgcccgtagtccggcctcgtccgtacggcccgcccgtaagttcggtacgacccgaaccgaaaccgaaaccgggcccgggaacccgacggaacccgcgggaccgccgtaccgtaggtacggaacgcgacggaccgacnccgacggccgagccggcgtcggtgggacggggcgacgggtccgacgacccggaacggtcccgtcccgtcccccgtcggtaaccctcccgttcccggtcccgttcccccgtccccctcccgtacccgtacccggg

SEQ ID NO: 392708 - DNA, 547 bp, Homo sapiens
  misc_feature: GZ8MTXP02IHYNP.19.80.H03.1.454.CMB.2.raw
  modified_base (241)..(241): a, c, t, g, unknown or other
  modified_base (244)..(244): a, c, t, g, unknown or other
  modified_base (258)..(258): a, c, t, g, unknown or other
  modified_base (261)..(261): a, c, t, g, unknown or other
  modified_base (266)..(266): a, c, t, g, unknown or other
  modified_base (276)..(276): a, c, t, g, unknown or other
  modified_base (283)..(283): a, c, t, g, unknown or other
  modified_base (287)..(287): a, c, t, g, unknown or other
  modified_base (290)..(290): a, c, t, g, unknown or other
  modified_base (331)..(331): a, c, t, g, unknown or other
  modified_base (377)..(377): a, c, t, g, unknown or other
  modified_base (417)..(417): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagngtnccctgactgagcanganccagnagcagtggtngagcccngagngcngggccctggccaggcagcgctgccctgctgctgcctggtcnggccagtcgtccgccagtcggcctgctcgcgccctaagtcggttcnccaacgcgaaacggcccgggaacccagaccccgtgggacnctcgagtggaacgcacgccgatccagcctgcggacgccgtggtcgggctacgggcacggacccgaaggccctcggcccccgttcggaacccacttcccgtccttcccccaccctttcccgacccaaccgg

SEQ ID NO: 392709 - DNA, 609 bp, Homo sapiens
  misc_feature: GZ8MTXP02G60DP.19.80.H03.1.454.CMB.2.raw
  modified_base (222)..(222): a, c, t, g, unknown or other
  modified_base (299)..(299): a, c, t, g, unknown or other
  modified_base (380)..(380): a, c, t, g, unknown or other
  modified_base (451)..(451): a, c, t, g, unknown or other
  modified_base (487)..(487): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaaggtcgggcaggaggtcgcccctgaacctggaaggccaatgagacccaagacaggccaagtggtgngagacccctgaggagctgggccctggccccaggcaggcgcgtcggccctgctgcgtgccgtgggtctcggccagtcggtcncccgtagtcggccctgcctcgaccgcccaagtcggttcgcgaccgcgaaacggccgggacccacgacccgnggacgccgtacgaggttacggacgcgacgccgaccnccgacgccgcgcggacgtccgtgggcgggacgacggacgaccggacccgacggcccgtcccggtcccccgtacgtccctaccgttcccgttcccgtaccccctccccgtcccgtaccgaccg

SEQ ID NO: 392710 - DNA, 654 bp, Homo sapiens
  misc_feature: GZ8MTXP02H9V0P.19.80.H03.1.454.CMB.2.raw
  modified_base (220)..(220): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggcagaggtcgcccctgaacctgaaggccaatgagacccaagacagccaagtgggtgtgagaccccgtgaggagcgtcgggccctggtcccaggcgacgcgctcggcccctcgctgctgccgtgggtctcggccagtcgggtaccgcccgtactcgggtccctgtccgtacggcccgtccctaaacgtcgggtttcgaccgaaccgacgaaaaccgggccggggaccccgaacggtaccccgtacgggacgtccgtaccgtaggttagggaacgcacggcccgaactcccgagcccgtggccggagccgtggcggggacgacggtcacggacccgacgggccctccggcccccgttcgggtaacctacccgttccgttacccggttcccccgtccccgttacccgtacccgtaaccgg

SEQ ID NO: 392711 - DNA, 584 bp, Homo sapiens
  misc_feature: GZ8MTXP02JLBTJ.19.80.H03.1.454.CMB.2.raw
  modified_base (221)..(221): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggancccatgctgcaagtcggcagaggtnccctgaacctgaaggccaatgagacccaagacaggccaagtgggtgtgacgacccctgaggagctgggccctggtcccaggcagcgctcggcccctgctgctgccgtgggtctcggcctagtcggtccgcccgagtcggcccttgctcgccgacccgtaagtcggttcgccaccggacgaaacgggccgggacccagacccgtggacgcctacgagtacggacgcacgccgatccacgcctggacgacgcggtgcggggtctacggtcgacgcccgaacggccgtaccgccccgtcggtcctaccgtccgtccgtcccctacctcccgtaccaaccgg

SEQ ID NO: 392712 - DNA, 582 bp, Homo sapiens
  misc_feature: GZ8MTXP02HXZ9D.19.80.H03.1.454.CMB.2.raw
  modified_base (168)..(168): a, c, t, g, unknown or other
  modified_base (178)..(178): a, c, t, g, unknown or other
  modified_base (221)..(221): a, c, t, g, unknown or other
  modified_base (369)..(369): a, c, t, g, unknown or other
  modified_base (375)..(375): a, c, t, g, unknown or other
  modified_base (395)..(395): a, c, t, g, unknown or other
  modified_base (469)..(469): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacngccctgctggcgagagggaccagggcaccgtcctccgagggancccatgctgcaagtcggccaggaggtcgcccctgaacctgaacggccaatgagacccaagacaggccaagtgggtgtgacgaccccgtgaacgagcgtcgggccctggtcccaggcagcgctggcccctgctgctgcctgggtctgcntcggcnccgagtcggcctgctcgccncccagtcggttcgcaccgacgaaacggcggggaccccagacccgtggacgcctgagtcggaagcaacgccgacncgagccgtggcggacgccgttaggcggggaccacgggtccacggaccgaacgtccgtccgcccccgtaggtccctactccgttccggttcccctacccgtccctaccgaacgg

SEQ ID NO: 392713 - DNA, 604 bp, Homo sapiens
  misc_feature: GZ8MTXP02G30FF.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccagggagcccatgctgcaagtcgggccagaggtgcccctgaacctgaaggccaatgagacccaagacaggccaagtgggtgtgagacccctgaggagcgtgggccctggtccccaggcagcgctggcccctgctgctgcctggggtctggccagtcggtcgccccgagtcgggcctgcctcgccgccctaagtggttcgccgaccggacgaaaacgcccgggggaacccacggaccccgtggaccgccgtaccgaaggttacggaacgcgacgccggactcccgagcccgtaggcggacgtcccgtgggtcggggctacgggcacggcccgaaaggcccgtccggccccctcggtcctaccgtcctccgtcccctaccctccctaccaacgg

SEQ ID NO: 392714 - DNA, 681 bp, Homo sapiens
  misc_feature: GZ8MTXP02IJRNX.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggagcccatgctgcaagtcgggcagaggtgccctgaacctgaagccaatgagacccaagacaggaccaagtgggttgtgacgacccctggacggagcgtgggccctggtccccaggcagcgctggcccctgctgctcgtccgtgggtccgtgcccgtagttcgggtccgcccgtagtcgggcccgttgcccgttggaccgcccccgtaaagttcggttcgacccgaaccggacgaaaccgggccggggaacccccgaaggaccccgtaggaccgcctacggtacgttacggaacgcgacgaccgactcccgagcctggccggagtcccggtggcggggtacgacggggttaccgaacggtaccccgaaacggtcccgtacccggtccccccgttacgggtaacccgttaccccgttccgtttaccccggttaccccctaccccgttcccgttaaccccgaacccgg

SEQ ID NO: 392715 - DNA, 617 bp, Homo sapiens
  misc_feature: GZ8MTXP02F9RPN.19.80.H03.1.454.CMB.2.raw
  modified_base (212)..(212): a, c, t, g, unknown or other
  modified_base (220)..(220): a, c, t, g, unknown or other
  modified_base (246)..(246): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtccnccagggancccatgctgcaagtcggcagaggtcnccctgaacctgaaggccaatgacgaccaagacaggccaagtgggtgtgacgaccccgtgaggagcgtcgggccctggtcccaggcaggcgcgtcgcccctgctgctgccgtgggtctggacctgtcggtccgcccgagtcggccttcgcgtcggccgacccgtaagttcggttcgccgaaccggacgaaacggccggggacccacgacccgtggaccgcctacgacggttggaacgcgaacgccggactacccgacgcccgtaggacggcgccggtgggcgggacgtacgggcgacggacccgaacggcctcccggccccgtcggccctaccgttcctccgttccccctaccccttccgaccgtaaaccgg

SEQ ID NO: 392716 - DNA, 543 bp, Homo sapiens
  misc_feature: GZ8MTXP02FFTGQ.19.80.H03.1.454.CMB.2.raw
  modified_base (477)..(477): a, c, t, g, unknown or other
  modified_base (483)..(483): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggtgtgagacccctgagagctgggccctggtcccaggcagcgctcggcccctgctgctgcctgggtctggccagtcggtcgcccagtcggccttgctgcgcccaatggttcgcaccgcgaaaacgccggggacccgagacccgtggacgcctcgaggtggaacgcacgccgatccagccctgacggnccgtgnggggcaggcacgccaaggcctcgccccgttcggccactcctcgtcccaccctcctccacg

SEQ ID NO: 392717 - DNA, 636 bp, Homo sapiens
  misc_feature: GZ8MTXP02FKZEC.19.80.H03.1.454.CMB.2.raw
  modified_base (219)..(219): a, c, t, g, unknown or other
  modified_base (266)..(266): a, c, t, g, unknown or other
  modified_base (288)..(288): a, c, t, g, unknown or other
  modified_base (512)..(512): a, c, t, g, unknown or other
  modified_base (523)..(523): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggancccatgctgcaagtcggcagagtcgccctgaacctgaagccaatganaccaagacaggcaagtgggtgngacgaccccgtagaggagcgtcgggcccgtcggtcccgaggccgagcgccgtcggcccctgccgtcgccgtggcccgttcggggtcctcggaccgtacgtcggtccgtccgcgtcggccgtcgcgtcgaccgcccgtaagtcggttcgaccgaccgacgaaacgggacccgggaacccacggaacccgtggaccgccgtacgagtacggacgcgacgaccgacncccgagtccgnggacggcgtccgtgggcgggcgaacggccgacggacccgaacggcccgtccggtcccccgtcgggtccctccgtcccgttccggtccccctcccgtaccctacccgtaaccgg

SEQ ID NO: 392718 - DNA, 635 bp, Homo sapiens
  misc_feature: GZ8MTXP02FHO4K.19.80.H03.1.454.CMB.2.raw
  modified_base (219)..(219): a, c, t, g, unknown or other
  modified_base (247)..(247): a, c, t, g, unknown or other
  modified_base (332)..(332): a, c, t, g, unknown or other
  modified_base (393)..(393): a, c, t, g, unknown or other
  modified_base (402)..(402): a, c, t, g, unknown or other
  modified_base (436)..(436): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagaggaccagggcaccgtcctccaggacncccatgctgccaaggtcggccagaggtncccctgaacctgaaggccaatgagacccaagacaggccaaagtgggtgtgagacccctgaggagctgggcccctggtcccaggcngcgctggcccctgctgctgccctgggtctggccagtcggtcgcccagtcggcctgctgccnccagtgtcnccaccgcgaaacggccgggacccacggtacccgnggaacgccgtacgaggttcggaacgccgaagcccggaactcccgaagcccgtggcccgggagtcccgtgggtacggggacctacgggtaccgacggacccccgaaacggccccgttaccggccccccccttacggggttccccgaaccttccccgttcccggttccccccgtaaccccttccccgtacccgaaacccgg

SEQ ID NO: 392719 - DNA, 655 bp, Homo sapiens
  misc_feature: GZ8MTXP02G20AU.19.80.H03.1.454.CMB.2.raw
  modified_base (168)..(168): a, c, t, g, unknown or other
  modified_base (223)..(223): a, c, t, g, unknown or other
  modified_base (247)..(247): a, c, t, g, unknown or other
  modified_base (272)..(272): a, c, t, g, unknown or other
  modified_base (275)..(275): a, c, t, g, unknown or other
  modified_base (294)..(294): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacncccatgctgcaaggtcgggcaggnggtcgccctgaacctgaaggccaanganaccagacaggcaagtggtngagccctgaggagcgtgggccctggtccccaggcagcgcgtcggccctgctgctgccgtgggactggcctagtcggtcgcccgagtcggcctcgactcgaccgtccctaagtcggttacgccgaccggacggaaacgggaccggggacccgacggacccgtgggacctacccgtagtacggttaggaacgtcgacgacccgacacccgacggcccggcggccggtacggaccggtgggtacgggtacggacgggtaccgaccgggaccggtaccggtccgtccccggtacccccgtccggtcccgtacccgttacccgttccccggttccccgtacccccgttacccgtacccgtaaccgg

SEQ ID NO: 392720 - DNA, 567 bp, Homo sapiens
  misc_feature: GZ8MTXP02IYLBD.19.80.H03.1.454.CMB.2.raw
  modified_base (310)..(310): a, c, t, g, unknown or other
  modified_base (326)..(326): a, c, t, g, unknown or other
  modified_base (359)..(359): a, c, t, g, unknown or other
  modified_base (387)..(387): a, c, t, g, unknown or other
  modified_base (391)..(391): a, c, t, g, unknown or other
  modified_base (417)..(417): a, c, t, g, unknown or other
  modified_base (465)..(465): a, c, t, g, unknown or other
  modified_base (472)..(472): a, c, t, g, unknown or other
  modified_base (475)..(475): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcgggccaggacggtcgcccctagaaccctggaacggccaagtgaacgacccaagacaggaccaaggtgggtgngacgacccctggaggngcgtcgggcctcggccaggcagcgctcggcccngctgctcgccgtggctgcctagtcggcnccgngtcggcctgctcgcgcctagtcgtcnccgacgacgaacggccgggaccacggccgtagcgcgtagagtgacgcncgcgacncgngcgcggcgcgcgtggcggcgcggcacggccgacggtcccgtaccgtcccgtcgtccgtccgtcccgtccgtccccacccgtaccgaccgacg

SEQ ID NO: 392721 - DNA, 593 bp, Homo sapiens
  misc_feature: GZ8MTXP02IQ1TG.19.80.H03.1.454.CMB.2.raw
  modified_base (220)..(220): a, c, t, g, unknown or other
  modified_base (369)..(369): a, c, t, g, unknown or other
  modified_base (377)..(377): a, c, t, g, unknown or other
  modified_base (381)..(381): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtcgcccctagaacctggaaggccaagtgagacccaagacaggccaagtgggtgtgacgacccctgaggagctcggggccctggtcccaggcagcgctcggccctgctgctgcctgggtctggcngtcggtcnccgntcggcctgctcgcgtccagtgtcgcacgcgaaacggcgggaacccgacgacccgtcgggacgccgtcgaggttcggaacgtcgacggccgacgtccgacgccgtcggcggacgccgtgggcgggtacgacggtcgacggacccgaacggtccgtcccgccccgtcggtccgaccgtccgttcccgttccccgcccttcccgtacctaaccgg

SEQ ID NO: 392722 - DNA, 603 bp, Homo sapiens
  misc_feature: GZ8MTXP02GHY31.19.80.H03.1.454.CMB.2.raw
  modified_base (245)..(245): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggcagagtncccctgacctgaaggccaatgagacccaagacaggccaagtgggttgtgagacccctgaggagctgggcccctggtccccaggtcaggccgcgtcggcccctgcctgctcgctcggggtctggccagtcggttccgcccgagtcggcctgccttgccgccctaaagtcggttcgccgacccggacgaaaacgggccggggaaccccgacggaccccgtgggacgccctacgacggttggaaacgcgacggccgaatcccgagccgtgcggacgccgtgggcggggcagggtccacggcccgaaggccctcgcccccgtggcccacgtcctacgttccccaccctcccgacgtaaccgg

SEQ ID NO: 392723 - DNA, 647 bp, Homo sapiens
  misc_feature: GZ8MTXP02GE5SD.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccagggccaccgtcctccgagggacgcccatgctgcaaggtcggccagacggtcgcccctgaacctggaacggccaaatgacgacccaagaccaggaccaaggtgggttgtgacgaccccgtgaggagcgtgggccccgtggtccccgaggcacggcgccgtcggcccctgcctgcctggccgtgggtcctggccgtagtcggccgcccagtcggcctgcctcggccgaccgtaagtcggttacgaccgaccgacggaaaccgggaccggggaaccccaggaacccgagtacgggacgccgtacggaggttacggaagccgacggccgactcccgacgccgtaggccggtagccggtgggtacggggcgagggtccaacggcccgaacggcccgtcccggtaccccgtggtacccacgttccctccgtccccctaccctcccgtacccg

SEQ ID NO: 392724 - DNA, 602 bp, Homo sapiens
  misc_feature: GZ8MTXP02IJDPD.19.80.H03.1.454.CMB.2.raw
  modified_base (169)..(169): a, c, t, g, unknown or other
  modified_base (221)..(221): a, c, t, g, unknown or other
  modified_base (366)..(366): a, c, t, g, unknown or other
  modified_base (377)..(377): a, c, t, g, unknown or other
tcagtactctcgtgcacgaccggtgctcgatttagctgtgcgtcgaagggaaaggggccctctgggagagatccccaggggtgacagccatggaccctgggaagggcctgggctagggacagggaccagagccagtccagggagaggacagagccaatggactggggtntactgtaacagccctgctggcgagagggaccagggcaccgtcctcgaggganccatgctgcaaggtcggcaggaggtcgccctagaacctggaacggcaatgacgacccaagacaggaccaaggtgggtgtagacgacccctgaggagcgtcgggccctcggcccaggcagcgcgtcgccctgctgctgcgtggtcnggcagtcggcnccagtcgcctgctcgccgccaagtcggtcgacgaccgacgaaacggccgggaacccacgacccgtaggaccgccgtacgtacggttcggaacgcgacgaccgactaccgacgccgtggccggacgtccggtgggcggggcgacggtccggacgacccggacggcccgtcccggccccgtcgtcctacctccgttcccgtacccctcccctacctacccgaaccgg

SEQ ID NO: 392725 - DNA, 677 bp, Homo sapiens
  misc_feature: GZ8MTXP02JR5RA.19.80.H03.1.454.CMB.2.raw
  modified_base (168)..(168): a, c, t, g, unknown or other
  modified_base (295)..(295): a, c, t, g, unknown or other
  modified_base (311)..(311): a, c, t, g, unknown or other
  modified_base (367)..(367): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctcgagggacgcccatgctgcaagtcgggccagaggtcgcccctgaacctgaagccaatgagacccaagacaggccaagtggtgngagaccctgaggagcngggcctggccaggcagcgctcggccctgctgctggcctggctggccagtcggtccncccgatcggcctgcctcggaccgcccgtagtcggttcgaccgaccgacgaaacgggccgggtacccaacggaccccgtagggaccgtaccgtaccgaggttacgggaaacgccgaacggacccggaacgtcccgacggccgtacgggccggacgtcccggttgggcgggggtaccacgggggttcccgaacgggaccccgaaacggggtcccctccccggggtacccccgtttaccggggcccttaaaccccgttccgtttcccccggtttaaccccccctacccccgtttaccccgtaacccgtaacgg

SEQ ID NO: 392726 - DNA, 644 bp, Homo sapiens
  misc_feature: GZ8MTXP02G1D9X.19.80.H03.1.454.CMB.2.raw
  modified_base (225)..(225): a, c, t, g, unknown or other
  modified_base (309)..(309): a, c, t, g, unknown or other
  modified_base (322)..(322): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgaggagggaccagggccaccgtcctccgaggggacncccatgctgcaaggtcgggccaggaggtcgcccctgaacctggaacggccaagtgaacgacccaagacaggaccaaggtgggtngacgccctgaggngcgtcgggccctggcccaggcacgcgcgtcggccctgctgctgccgtgggtctcggcctagtcggccgcccgtagtcggcctgccgtcgaccgaccctagtcgtcgccgaccgacgaaaccggccgggaccccgacggaccccgtaggacgccgtacgacggtcggaacgcgacgccgactccgacgccgtcggacggacgtccgtgggtcgggccgtacgggccgaccggacccggaacggtcccgtacccggtcccccgtacggtcccgtaccgttcccgttcccgtaccccctaccccgtccccgtacccgtaacccgg

SEQ ID NO: 392727 - DNA, 586 bp, Homo sapiens
  misc_feature: GZ8MTXP02JWBZL.19.80.H03.1.454.CMB.2.raw
  modified_base (222)..(222): a, c, t, g, unknown or other
  modified_base (359)..(359): a, c, t, g, unknown or other
  modified_base (364)..(364): a, c, t, g, unknown or other
  modified_base (370)..(370): a, c, t, g, unknown or other
  modified_base (373)..(373): a, c, t, g, unknown or other
  modified_base (389)..(389): a, c, t, g, unknown or other
  modified_base (475)..(475): a, c, t, g, unknown or other
  modified_base (567)..(567): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccagggacncccatgctgcaagtcgggccagaggtcgccctgaacctgaaggccaatgagacccaagacaggccaaagtggtgtgagacccctgagagctgggccctggcccaggcacgcgctggcccctgctgctgccgtggtcnggccngtgtcnccntcggcctgcgtcgccncccgtaatcggttcgcgaccgacgaaacggccggggaacccacggacccgtcgggacgcctgacggttcggaacgcacgccgaccnccgacgcgacggcggacgcgtggcgggcgacggcgacggacccgacggtcccgtcccgtccccgtacgtcccgtccgtccgttccctccccncccttaccgtacccgtacg

SEQ ID NO: 392728 - DNA, 559 bp, Homo sapiens
  misc_feature: GZ8MTXP02GHDAA.19.80.H03.1.454.CMB.2.raw
  modified_base (219)..(219): a, c, t, g, unknown or other
  modified_base (240)..(240): a, c, t, g, unknown or other
  modified_base (243)..(243): a, c, t, g, unknown or other
  modified_base (262)..(262): a, c, t, g, unknown or other
  modified_base (265)..(265): a, c, t, g, unknown or other
  modified_base (272)..(272): a, c, t, g, unknown or other
  modified_base (286)..(286): a, c, t, g, unknown or other
  modified_base (390)..(390): a, c, t, g, unknown or other
tcagtactctcgtgcacgaccggtgctcgatttagctgtgcgtcgaagggaaagggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgaggancccatgctgcaagtcggcagngtnccctgaacctgaagccaanganacccaanacagcaagtggtgngagaccctgagagctggccctggtcccaggcagcgctcggcccctgctgctgcctgggctggcctagtcggtcgccatcggcctcgctcgcgcccaatcggtcncgaccgacaaacggcgggacccagacccgtgacgcctacgagtggaacgcgacgaccgaatcccagcctaggccgagccgtggcgggacaggtccacgcccgaaggcccgtcgcccccgtacggtcctacccgttcgaccgttcccccacccgttcccaccgtaaccgg

SEQ ID NO: 392729 - DNA, 678 bp, Homo sapiens
  misc_feature: GZ8MTXP02JMXT8.19.80.H03.1.454.CMB.2.raw
  modified_base (293)..(293): a, c, t, g, unknown or other
  modified_base (360)..(360): a, c, t, g, unknown or other
  modified_base (371)..(371): a, c, t, g, unknown or other
  modified_base (385)..(385): a, c, t, g, unknown or other
  modified_base (394)..(394): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggcagaggtgccctgaacctgaagccaatcgagacccaagacaggccaagtggttgngttacgacccctggaggagctgggccctggtcccaggcagcgctcggcccctgctgctgcctggtcngcagtgcgccngtggcctgctcgcnccatggtcncgacgcaaggccgggacccacgacccgtggacgccgtacgacggttacggaacgcgaccgccgaacgtcccgacggtcccgtacgggaccggacgggtccccgtggggtcgggggtaccgttacgggacccggaaccggacccccgtaaacgggggtccccgttaaccccgggggtcccccccgtttccgggggtaaacccctaccccggtttccccgtttaccccggggtttccccccccgtcccccggtttaaccccccgtttccccggtaaaacccccggg

SEQ ID NO: 392730 - DNA, 620 bp, Homo sapiens
  misc_feature: GZ8MTXP02JA7BW.19.80.H03.1.454.CMB.2.raw
  modified_base (319)..(319): a, c, t, g, unknown or other
  modified_base (381)..(381): a, c, t, g, unknown or other
  modified_base (523)..(523): a, c, t, g, unknown or other
  modified_base (529)..(529): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcgagggacgccatgctgcaagtcggcagacggtcgcccctgaacctggaacgccaatgaagacccaagacgaggaccaaggtgggtgtagacgacccctgaggagcncgggcctggtcccaggcagcgctcggccctgcctgctgccgtggtctacgctagtcggtccnccctagtcgggccctggcctacgccgtaccctaagtcggtacgccgaaccgacgaaaccgggaccggggaaccccaacggtacccgtggaccgtccgtacgacggttcgggaaacgcgacgacgacgcacgcctcggacggngtccgnggtcggggacgcggtacgacggaccgacggtccgaccgtccccgtcggaacctcgtacccgtccgttacccccacccttcccaccgaaccg

SEQ ID NO: 392731 - DNA, 541 bp, Homo sapiens
  misc_feature: GZ8MTXP02GYLCC.19.80.H03.1.454.CMB.2.raw
  modified_base (244)..(244): a, c, t, g, unknown or other
  modified_base (287)..(287): a, c, t, g, unknown or other
  modified_base (350)..(350): a, c, t, g, unknown or other
  modified_base (360)..(360): a, c, t, g, unknown or other
  modified_base (429)..(429): a, c, t, g, unknown or other
  modified_base (441)..(441): a, c, t, g, unknown or other
  modified_base (451)..(451): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggcagagtnccctgaacctgaagccaatgagaccaagacaggcaagtgggtngagaccctgagagctgggccctggtcccaggcagcgcgtcggcccctgcctgctgcctggtcnggccatcgcncccatggcctgctcgcgcccaaagtgttcgcacgacaaaacgcggggacccagaaccctggacgccctnagttggaaacgngacgaccganaccgagctcgcgacgcgtcgtggcgacgacgacgaccgacgcgccgcccgtccgtcgtactccgtccgtcccgtccctcccgtaccgacg

SEQ ID NO: 392732 - DNA, 675 bp, Homo sapiens
  misc_feature: GZ8MTXP02HUJGE.19.80.H03.1.454.CMB.2.raw
  modified_base (168)..(168): a, c, t, g, unknown or other
  modified_base (222)..(222): a, c, t, g, unknown or other
  modified_base (373)..(373): a, c, t, g, unknown or other
  modified_base (390)..(390): a, c, t, g, unknown or other
  modified_base (518)..(518): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccgagggacncccatgctgcaaggtcggaccaggacggtcgcccctagaacctggaacggccaatgagacccaaggacaggccaaggtggtgtgacgacccctggaggagcgtcgggccctggcccaggcagcgctcggccctgctgctcgccgtggtccncggcagtcggtcgcccngtcggcctgcctacggccgccctaatcggttcgccgacccggacgaaacgggcccgggggaaccccaacggaccccgtacgggaccgcccgtacggacggttacgggaacggcgaacggcccggaacnccgacggtcccgcggccgggacgtcccggttaggggcggggtcgacgggtccacggaccccggaacggtcccgtacccggtcccccgtccgggtaaccctccggttcccgttaccccggttccccctaacccccgtcccgttaacccgtaacccggg

SEQ ID NO: 392733 - DNA, 632 bp, Homo sapiens
  misc_feature: GZ8MTXP02FRVIW.19.80.H03.1.454.CMB.2.raw
  modified_base (168)..(168): a, c, t, g, unknown or other
  modified_base (220)..(220): a, c, t, g, unknown or other
  modified_base (243)..(243): a, c, t, g, unknown or other
  modified_base (247)..(247): a, c, t, g, unknown or other
  modified_base (312)..(312): a, c, t, g, unknown or other
  modified_base (416)..(416): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggancccatgctgcaaggtcggccagnggtncccctgaacctgaaggccaatgagacccaagacaggccaaggtgggtgtgacgacccctgaggancgtcgggccctggtcccaggcagcgcgtcggcccctgcctgctgccgtgggtctaggcctagtcggccgcccagtcggcctgctcgccgaccctagttggtacncgaccgacgaaacgcccggggacccacgacccgtaggaccgtcctacgacgttagggaaacgcgacgacccgtacgacccgacgcccgtggccgggacgtcgtcgggtcggggaccgtagggaccacggaccccgaaagggtccccgttaccggcccccgttaggtcccaccgttccgttacccggttcccccaacccttcccgtacccgtaacgg

SEQ ID NO: 392734 - DNA, 613 bp, Homo sapiens
  misc_feature: GZ8MTXP02F8GDQ.19.80.H03.1.454.CMB.2.raw
  modified_base (368)..(368): a, c, t, g, unknown or other
  modified_base (381)..(381): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccaggaggtcgcccctgaacctgaaggccaatgagacccaagacaggccaagtgggtgtgagacccctgaggagctgggccctggtcccaggcagcgcgtcggcccctgctgctgccgtgggtctggccngtcggtcgcccgngtcggcctgctcgcgcccagtcggtcgcgacgcgaaacggccgggacccacggacccgtgggacgtccgtacgaggttacggaacgtcgacgtccgactcccgaacggcctacggccggacgcccgtggggtcggggacgtacgggccgaacggacccgaacggtccgtccggtcccccgtcggccgtacccgtccgttcccggttcccccacccgtccctcccgtaaccgg

SEQ ID NO: 392735 - DNA, 659 bp, Homo sapiens
  misc_feature: GZ8MTXP02JYOL8.19.80.H03.1.454.CMB.2.raw
  modified_base (168)..(168): a, c, t, g, unknown or other
  modified_base (220)..(220): a, c, t, g, unknown or other
  modified_base (384)..(384): a, c, t, g, unknown or other
  modified_base (456)..(456): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagaggaccagggcaccgtcctccagggacncccatgctgcaaggtcgggccaggaggtcgcccctgaacctggaacggccaatgagacccaagacaggccaaagtgggttgtgagaccccctgaggagctgggccctggtcccaggcagcgcgtcggcccctgctgctgcccgtgggtctcggccagtcggtcncccgagtcggcctgctcgcgccctaagtcggtcgccgacgacgaaacggccggggaacccacgtaaccccgngggacgcctacggaaggttacggaacgcgacggacccgaacgtcccgaaggccccgtagggccggtacggcccgtgggtacggggacgacggggtaccgaccggaccccgaaacgggcccgtcccggccccccgttacggtcccgtccgttccccgtcccggtttccccccggccccctttccccgtacccgtaaaccccggg

SEQ ID NO: 392736 - DNA, 632 bp, Homo sapiens
  misc_feature: GZ8MTXP02JMP5L.19.80.H03.1.454.CMB.2.raw
  modified_base (221)..(221): a, c, t, g, unknown or other
  modified_base (249)..(249): a, c, t, g, unknown or other
  modified_base (296)..(296): a, c, t, g, unknown or other
  modified_base (399)..(399): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcaaggtcgggcagaggtcncccctgacctgaaggccaatgagacccaagacaggccaagtgggttntgacgaccccgtgacggagcgtcggggtcccctgggtccccgaggcagccggtctcggcccctgcctggctgccgtcggggtctcggccagtcggtcgcccgngtcggcctgccgtacgccgaccgtagtcggttcgcaccgcgaaacggcgggacccgacggaacccgtggaccgtcctaggacggttaggaacgccgacgcccgaactcccgacggtccgcggccggacggttccggcggtcggggacgtacgggtcgacggccgaaacggtcctacccggccccgtcgaaccgtccttccgtacccgtccctaccccgtcctacccgaaccgg

SEQ ID NO: 392737 - DNA, 583 bp, Homo sapiens
  misc_feature: GZ8MTXP02GFWJ2.19.80.H03.1.454.CMB.2.raw
  modified_base (168)..(168): a, c, t, g, unknown or other
  modified_base (178)..(178): a, c, t, g, unknown or other
  modified_base (223)..(223): a, c, t, g, unknown or other
  modified_base (244)..(244): a, c, t, g, unknown or other
  modified_base (248)..(248): a, c, t, g, unknown or other
  modified_base (270)..(270): a, c, t, g, unknown or other
  modified_base (359)..(359): a, c, t, g, unknown or other
  modified_base (371)..(371): a, c, t, g, unknown or other
  modified_base (443)..(443): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacngccctgctggcgagagggaccagggccaccgtcctccgagggacncccatgctgcaagtcggcagnggtnccctgaacctgaagccaatganccaagacaggccaagtgggtgtgagacccctgaggagctggggccctggtcccaggcaggcgcgtcggcccctgctgctgccgtggtcngccagtcggtcncccgatcggcctgccgtacgccgcccagtcggtcgcgaccgacgaaacgccggggacccagacccgtggacnccgtcgagttcggaacgcgacgccgactcccgagccgtggcgacgccgtggcgggacgtacggcacggccgaacggccgtcccggccccgtcgtaacccgcgttccgtcccgttccccgcccgtcccgtacccgaaccgg

SEQ ID NO: 392738 - DNA, 626 bp, Homo sapiens
  misc_feature: GZ8MTXP02JIJTD.19.80.H03.1.454.CMB.2.raw
  modified_base (369)..(369): a, c, t, g, unknown or other
  modified_base (376)..(376): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggacgcccatgctgcaaggtcggcagaggtgcccctgaacctgaacggccaatgagacccaagacaggccaagtgggttgtggacgaccccctgaggagcgtgggccctggtcccaggcagcgctcggcccctgctgctgccgtggctgcntcggtcncccgagtcggcctgcgtcgccgccctaagtcggttcgccgaccggacgaaacggcccggggaacccacggaccccgtagggaccgccgtacgaggttcgggaaacgccgacggcccgatacccgacgccgtcggcggacgcccgttggcggggcgacggtcgaaccggccgaacggtcccgtaccggcccccgtacggtcccacgttcccgtacccggttcccccacccgttccccgtaccgtaacccgg

SEQ ID NO: 392739 - DNA, 604 bp, Homo sapiens
  misc_feature: GZ8MTXP02H8XIW.19.80.H03.1.454.CMB.2.raw
  modified_base (168)..(168): a, c, t, g, unknown or other
  modified_base (221)..(221): a, c, t, g, unknown or other
  modified_base (270)..(270): a, c, t, g, unknown or other
  modified_base (306)..(306): a, c, t, g, unknown or other
  modified_base (372)..(372): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacnccatgctgcaagtcgggccagaggtcgcccctgaactgaagccaatganacccaagacagacaagtggtgtgagaccctgaggancgtgggccctggtcccaggcagcgctcggcccctgctgctgccgtcgggtctaggccagttcggcncccatcggcctgcctcgacctcccgaatcggtacgccaaccggacgaaacggccggggaacccacgtaccgcggacgccgtacgtaggtaggacgcgaacgccggactcgacgtccgcgcccggtaccgtggtcgggacgcggtaccgacgacccgaacggcctaccgtcccccgtacgtccgtaaccgttccgtcccgtacccccgtccctaccctcccgtaacgaaccgg

SEQ ID NO: 392740 - DNA, 662 bp, Homo sapiens
  misc_feature: GZ8MTXP02F8YWB.19.80.H03.1.454.CMB.2.raw
  modified_base (168)..(168): a, c, t, g, unknown or other
  modified_base (249)..(249): a, c, t, g, unknown or other
  modified_base (264)..(264): a, c, t, g, unknown or other
  modified_base (267)..(267): a, c, t, g, unknown or other
  modified_base (274)..(274): a, c, t, g, unknown or other
  modified_base (279)..(279): a, c, t, g, unknown or other
  modified_base (284)..(284): a, c, t, g, unknown or other
  modified_base (290)..(290): a, c, t, g, unknown or other
  modified_base (297)..(297): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacgcccatgctgcaagtcgggcagagtcnccctgacctgagcanganaccagcngcagnggtgnagaccngagagcngggcctggccagcagcgcgtcggccctgctgctcgccgtgggtctcggccgtagtcggtcgcccgtagtcgggccctggccgtcgcccgaccgtaacgtcggttacgaccgaccggacggaaaccgggcccggggaccccgacggaccccgtagggaccgtccgtaccggtaacggttacgggaacgacgacggaccggaccgtaccccggacgtcccggtcggaccggggacggtccggtcggggtcggggacggtacgggaccgaccggacccggaacggtccccgtaccggtcccccgttacggtccgttaccgtcccgttacccgttccccgtaccccgtaccccgttacccgaacccggg

SEQ ID NO: 392741 - DNA, 610 bp, Homo sapiens
  misc_feature: GZ8MTXP02JDZ0N.19.80.H03.1.454.CMB.2.raw
  modified_base (168)..(168): a, c, t, g, unknown or other
  modified_base (212)..(212): a, c, t, g, unknown or other
  modified_base (372)..(372): a, c, t, g, unknown or other
  modified_base (376)..(376): a, c, t, g, unknown or other
  modified_base (383)..(383): a, c, t, g, unknown or other
  modified_base (487)..(487): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccgtccnccgagggacgcccatgctgcaaggtcggcagaggtcgccctgaacctgaacggccaatgacacccaagacaggccaaggtgggttgcgacgacccctggaggagcgtggggccctgggcccaggcacggcgcgtcggcccctgcgtgctgccgtgggtcngccngtcggcnccgagtcggccttgctcgccaccgtagtcgtcgaccgacgacgaaacgggccggaccgacgacccgtggaccgacgtacgacggtaggacgcgacgccgtaacnccgagccgtacggcgacgcgtcgggacgggcgacggtcgaccggaccgaacggtcccgtccgtcccccgtacggtccctaccgtcccgttaccgtcccccggtccctaacccgccgtaaccgg

SEQ ID NO: 392742 - DNA, 609 bp, Homo sapiens
  misc_feature: GZ8MTXP02H3DUQ.19.80.H03.1.454.CMB.2.raw
  modified_base (221)..(221): a, c, t, g, unknown or other
  modified_base (245)..(245): a, c, t, g, unknown or other
  modified_base (266)..(266): a, c, t, g, unknown or other
  modified_base (363)..(363): a, c, t, g, unknown or other
tcagtactctcgtgcacgaccggtgctcgatttagctgtgcgtcgaagggaaaggggccctctgggagagatcccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcggcagagtnccctgaacctgagccaatganacccaagacaggccaagtgggtgtgagacccctgaggagcgtgggccctggtcccaggcagcgctggccctgctgctgcctggtctggccatggtcncccatcggcctgctcgcgcccagtgttcgcgaccgacgaaacggccggggaacccacggaccccgtgggacgcctaccgaggtttcggaaacgcgaacggcccgaagtcccgaaggcccgtggaccggacgcccgtgggtcgggggcaggggtaccacggaccccgaaaggcccgtcggcccccctcgggtaaccctacccgtccgttccggtttacccccaccccgtttccctacccgtaaccgg

SEQ ID NO: 392743 - DNA, 700 bp, Homo sapiens
  misc_feature: GZ8MTXP02IPANF.19.80.H03.1.454.CMB.2.raw
  modified_base (243)..(243): a, c, t, g, unknown or other
  modified_base (246)..(246): a, c, t, g, unknown or other
  modified_base (261)..(261): a, c, t, g, unknown or other
  modified_base (264)..(264): a, c, t, g, unknown or other
  modified_base (319)..(319): a, c, t, g, unknown or other
  modified_base (357)..(357): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggagcccatgctgcaagtcggcagngtncctgacctgaagcanganaccagcagcaagtggtgtgacgccctgagagcgtgggccctggtcccaggcagcncgtcggcccctgcctgctcgtcctcgggtctcggaccnggtcggccgcccgtagtccggccttgccgtcgaaccgtcccgtaagtcggttacgccgaaccgacggaaaccggcccggggaaccccacggtaccccgtaacgggaccgtaccgtacggtacggttacgggaaacgtcgaaacccgtccgggaaacccttcccgacggtcccgttacggcccggaggtccccgggtgggttccgggggtacgaccgggttacgaaccggaccccggaaacggttaccccggtacccggtaccccccgtttaccgggtaaccctacccgttccccgttcccggtttaacccccccctaccccgttacccgtaacccgtaaccgg

SEQ ID NO: 392744 - DNA, 642 bp, Homo sapiens
  misc_feature: GZ8MTXP02IAKY4.19.80.H03.1.454.CMB.2.raw
  modified_base (223)..(223): a, c, t, g, unknown or other
  modified_base (313)..(313): a, c, t, g, unknown or other
tcagtactctcgtgcacgaccggtgctcgatttagctgtgcgtcgaagggaaaggggccctctgggagagatcccccaggggtgacagccatggaccctggaagggcctgggctagggacagggaccagagccagtccagggagaggacagagccaatggactggggtgtactgtaacagccctgctggcgagagggaccagggcaccgtcctccgagggacncccatgctgcaagtcggccagagtcgcccctgaacctgaacggccaatgacgacccaagacaggccaagtggtgtgacgacccctgaggngcgtgggccctcggtcccaggcagcgcgtcggcccctgctgctgccgtcgggtcgtggccgagtccgggtccgccccgagttcgggcccttcggccgtacgccgacccgtaagttcggtcgaccgaccggaccgaaacgggaccggggacccaacggaccccgtagggaccgaccgtacgtacggttcggaacggccgaacgccgactccgacgcctggacgtcggccgtgggtccggcgtacggccgacggacccgtacggcctcccggtcccctcggtccgtaccgttcccgtccgttcccccgtacccgttcccgtcccgaaccgg

SEQ ID NO: 392745 - DNA, 605 bp, Homo sapiens
  misc_feature: GZ8MTXP02F90SQ.19.80.H03.1.454.CMB.2.raw
  modified_base (247)..(247): a, c, t, g, unknown or other
  modified_base (293)..(293): a, c, t, g, unknown or other
  modified_base (309)..(309): a, c, t, g, unknown or other
  modified_base (371)..(371): a, c, t, g, unknown or other
  modified_base (395)..(395): a, c, t, g, unknown or other
  modified_base (399)..(399): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtncccctgaacctgaaggccaatgagacccaagacagccaaagtggtntgagacccctgagganctgggccctggtcccaggcagcgctcggcccctgctgctgccctgggtctggccatcggtcncccgatcggcctgctgcgcccaangttncacgcaaagcgggacccagacccgtgacgcctagacgttggaagcagacccgaactccgacgccgtacggcggacgtccgtagggtccgggacgacgggtaccgaacggaccccgaaacggtcccgtacccggacccccgttaccggtaacccgtacccgttccgttacccgttacccccgtaacccttccccgtacccgtaaccg

SEQ ID NO: 392746 - DNA, 716 bp, Homo sapiens
  misc_feature: GZ8MTXP02ILTKU.19.80.H03.1.454.CMB.2.raw
  modified_base (169)..(169): a, c, t, g, unknown or other
  modified_base (247)..(247): a, c, t, g, unknown or other
  modified_base (253)..(253): a, c, t, g, unknown or other
  modified_base (303)..(303): a, c, t, g, unknown or other
  modified_base (318)..(318): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaagtggactggggtntactgtaacagccctgctggcgagacgggaccagggcaccgtcctcgagggagcccatgctgacgaggtcgggcaggnggtccnccctgaaccgtgaacggccagtagacgaccgaagacaggacaggtggtgngacgacccgtgaggngcgtcgggccctcggtcccgaggccacggccgcgtacccggccccgtcgcgttcggccgtggtcccgttcggggtccgtacgccgtacggtccggttaccggccccgtagtccgggtctccgtccgttacggccgtacccgttaagttcggtccgaccgaaccgggacgaaaccggggacccggacccgtacggaaccccggtggaccgtcgtaccggtaaggtaccggaacgcccgacgtaccgccgaccgtaccggcgaccggtcgggaccgggttccgtcgggcggggaccggtacgggccgacccggtacccgacggccccgtacccgcccccggttcgtaaccccgtccgttcccgttcccgcccccggttccctacccgtccgtaaacccgg

SEQ ID NO: 392747 - DNA, 592 bp, Homo sapiens
  misc_feature: GZ8MTXP02HEL4B.19.80.H03.1.454.CMB.2.raw
  modified_base (244)..(244): a, c, t, g, unknown or other
  modified_base (291)..(291): a, c, t, g, unknown or other
  modified_base (306)..(306): a, c, t, g, unknown or other
  modified_base (326)..(326): a, c, t, g, unknown or other
  modified_base (355)..(355): a, c, t, g, unknown or other
  modified_base (364)..(364): a, c, t, g, unknown or other
  modified_base (366)..(366): a, c, t, g, unknown or other
  modified_base (372)..(372): a, c, t, g, unknown or other
  modified_base (379)..(379): a, c, t, g, unknown or other
  modified_base (465)..(465): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgaggacgcccatgctgcaaggtcggcaggngtcgccctgaacctgaacggccaatgacaccaagcaggccagtggtngacgacccgtgaggngctgggccctggccgaggcnggcgcgtcggccctgctgctgcctggtcngcagcgtcncngtgccngctgccnctagtcgtacgcacgagaacgccggacccacggtcccgtaggcgacccgtagacggtagacgcgacgcgtaacgccgacggtccgnggacggtggtacccgtggggtcgggccgtaacgggccaacggtccggaacgtcccggtacccggtccccgttacggcctaccgttcccggtcccgttccccgtcccccggtacgttccggaaaccgg

SEQ ID NO: 392748 - DNA, 722 bp, Homo sapiens
  misc_feature: GZ8MTXP02I6B4Y.19.80.H03.1.454.CMB.2.raw
  modified_base (655)..(655): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggagcccatgctagacgtacggtccggacgaggtacggtccgtcccgtacgtaaccgtaggaacgaccagtagaccaaccgaagacgacgactagggttggtgagacccgccgtaggacggacgtccggtccgggccccgttacggtaccccgagggtccgaacggtcccggtcccggttcccggtccccgtcgtccgtcgtcgtcggtccggttacggtcgtacgtcgtacgttcccggaccgcccgtggtcccggtcgtccgtccgtacggccccgtaccgtacggttcggtacccgaccgacccggaaacggaaccggggacccggacccgaccgaccggtacgcccgcgtacgtaggtacggacgcgacggaccctgacccgacgtcggcgacggccgtcgaggggtccgggaactcgggcgaccggtaaaccncgggtcccgaccggtccccgtaagtcccgtacgttccgtcccggtcccctcctaccggtaccaacgg

SEQ ID NO: 392749 - DNA, 627 bp, Homo sapiens
  misc_feature: GZ8MTXP02I8WCY.19.80.H03.1.454.CMB.2.raw
  modified_base (168)..(168): a, c, t, g, unknown or other
  modified_base (515)..(515): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggcaccggtcctccgagggacgcccatgctgcaaggtcgggccaggaggtcgcccctgaacctgaacggccaatgacgaccaagacaggcaagtggtgtgacgacccctggaggagcgtggggccctcggtcccaggccagcgctcggcccctgctgctgcctcgggtctggccgtatccggtccgcccgagtcggggcctgccgtacgccgtacccgaagtcggttcgcaaccggcgaaacgggccgggaccccaggacccgtggacgcgtcgaggttcggaacgtcgacgccgaacgccagccgtggacggngtccgtgggtacggggcgacggtaccgacggacccgaacgggcccgtccggtcccccgtacggtcctacccgttcgttccccgtccctaaccccgtcccgtacccgtaacgg

SEQ ID NO: 392750 - DNA, 658 bp, Homo sapiens
  misc_feature: GZ8MTXP02IQ3EQ.19.80.H03.1.454.CMB.2.raw
  modified_base (168)..(168): a, c, t, g, unknown or other
  modified_base (219)..(219): a, c, t, g, unknown or other
  modified_base (243)..(243): a, c, t, g, unknown or other
  modified_base (248)..(248): a, c, t, g, unknown or other
  modified_base (403)..(403): a, c, t, g, unknown or other
  modified_base (602)..(602): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagaggaccagggccaccgtcctccgaggncccatgctgcaaggtcgggccagnggtcncccctgaacctgaacggccaatgacgacccaagacaggccaaggtggtgtgacgacccctgaggagtcgtcgggccctggtcccaggcacgccgcctcgggccccctggacctcggtcgtgtcccgttgggtcctcgggtcctagtccgggtccncccgtagtcgggtccctggcctcgggacctacccgtaagtccggttacgcccgaccgaccgaaacggccgggaacccaggtacccgagtacggacgcccgtagacgggttcgaacgccgtaggacccgctaccgagcccgtgggaccggtacgccgtaggcggggacgacggaccgaccgggaccccaacggggtcccnccccggtcccgtccgacctaccgttcccgtaccttcccccgacccttcccgacccg

SEQ ID NO: 392751 - DNA, 676 bp, Homo sapiens
  misc_feature: GZ8MTXP02I3ZWR.19.80.H03.1.454.CMB.2.raw
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaagtcgggccagaggtcgcccctgaactgaaggcaatgacgacccaagacaggaccaaggtgggttgtgacgaccccgtgacggagcgtggggcccctcggtcccaaggcacggcgcgtcggcccctgctgctgccgtgggtctcggcctagtcggtaccgcccgtagtcgggtcccttgccgtcgcccgtaccctaaagtcggttacggccaacccggcgaaaaccgggccgggggacccccaacggaccccggtgggaccgcccgttacgacggttacgggacgacgacggccgacgtcccgacgccgtcggccggacgtccggtaggcggggacgtacggtccgacggaccccggaacggtcccgtccggtccccccggtcgtaacccgtaccgttcccgtacccgtttccccggacccccttccgtacccgtaaacccgg

SEQ ID NO: 392752 - DNA, 576 bp, Homo sapiens
  misc_feature: GZ8MTXP02F3KBG.19.80.H03.1.454.CMB.2.raw
  modified_base (291)..(291): a, c, t, g, unknown or other
  modified_base (501)..(501): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggccaccgtcctccgagggagcccatgctgcaagtcggcagacggtgcccctgaacctgaaggccaatgagacccaagacaggaccaagnggtgtgagacccctgaggagctgggccctaggtccccaggcacgcgcgtcggcccctgctgctgccctgggtctggcctagtcggtcgcccgatcggcctgcgtgccgcccaagtcggtcgctaccgcgaaagccggggacccagaccccgtagaccgctcgaggttaggacgcgacgccggaatcccgagccaggtcggagcccgtggngggcgtggacgacgccgaggccgtacgccccctggtccgacccgtcgtccgttccccgcctcccgtctaacccgg

SEQ ID NO: 392753 - DNA, 677 bp, Homo sapiens
  misc_feature: GZ8MTXP02GZ642.19.80.H03.1.454.CMB.2.raw
  modified_base (178)..(178): a, c, t, g, unknown or other
  modified_base (223)..(223): a, c, t, g, unknown or other
  modified_base (250)..(250): a, c, t, g, unknown or other
  modified_base (386)..(386): a, c, t, g, unknown or other
  modified_base (394)..(394): a, c, t, g, unknown or other
  modified_base (399)..(399): a, c, t, g, unknown or other
  modified_base (540)..(540): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacncgccctgctggcgagagggaccagggcaccgtcctccgagggacncccatgctgcaagtcggccagaggtcnccctgaacctgaacggcaagtgacgaccaagacaggccaaggtgggtatcgacgacccgtgacggagcgtcggggccctcggcccgaggcacggccgaccgtcggcccctgcctcgcgtgcccgtgggtctggccngtcggccnccgtntcgggcctaggcctcgaccaccgtagtcggttaccgccgaccggaggaaacccgggccgggtaaccccgacgtacccgacggaccgtaccgtacggtacggtacggacgtacggaccgacgaacgtcccgacgtcccgggngaccgggccggtcggtcggggtacgggacgacgggaccgaccgggacccggacggtcccgtaccccggtcccgtaccggtaaccgtacccgttccgttacccccggttcccccgtaccccgttcccgaccgtaccgg

SEQ ID NO: 392754 - DNA, 676 bp, Homo sapiens
  misc_feature: GZ8MTXP02I2SPV.19.80.H03.1.454.CMB.2.raw
  modified_base (168)..(168): a, c, t, g, unknown or other
  modified_base (223)..(223): a, c, t, g, unknown or other
  modified_base (419)..(419): a, c, t, g, unknown or other
  modified_base (424)..(424): a, c, t, g, unknown or other
  modified_base (665)..(665): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggacncccatgctgcaaggtccgggaccaggacggtcgcccctagaacctggaacggccaagtcgaacgacccaagacacggaccaaggtgggttgacgacgacccccgtaggaggacgtccgtcggggccctcgggcccaggcaggcccgcgtccggcccctgcctgctcggccgttggggtcctcggctagcgggtccncccgngtcggccgttcgccgtacgcccgacctaaggttcgtacgaccgaccgaacggaaaccggcccgggaaccccgacggtacccggtacgggacgtccgtacggaggtacggaacgcgaaccgcgactccgacgcgtcggacggcgccgtgggcgggtcgacggtccgacggacccgaacggtcccgtacccggtccccgtcggtcccgtaccgttcccgtcccgtcccccgtccccgtacccncccgtaaccgg

SEQ ID NO: 392755 - DNA, 606 bp, Homo sapiens
  misc_feature: GZ8MTXP02IFUDP.19.80.H03.1.454.CMB.2.raw
  modified_base (271)..(271): a, c, t, g, unknown or other
  modified_base (295)..(295): a, c, t, g, unknown or other
  modified_base (365)..(365): a, c, t, g, unknown or other
  modified_base (373)..(373): a, c, t, g, unknown or other
tcagtactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatganacccaagacaggccaagtgggtgngagacccctgaggagcgtgggccctggtcccaggcaggcgctcggcccctgctgctgccgtggctggccngtcggtcncccgatcggcctgcctacggctcccaagtggtcgccgaacgacgaaacggaccgggacccgacgacccgtcgacgcctacgacgttggaacgccgacgccgtacgtcccgaagccgtaggcggacggccgtcggtacggggcgagggtccgacgtcccgaaggcccgaccgtcccccgtcgggtaaccaccgtaccgtcccgttaccccgccccgttcccgtacccgtaccgg

SEQ ID NO: 392756 - DNA, 485 bp, Homo sapiens
  misc_feature: GZ8MTXP01D5AQN.10.76.G10.1.454.CMB.2.raw
  modified_base (305)..(305): a, c, t, g, unknown or other
  modified_base (479)..(485): a, c, t, g, unknown or other
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattatactgcccactctatgacaaacagcctgagttatttggctgttcgggcggcggacagttgaccgtctacgtcagcccaaggcctcgcccctcggtcacgttctcgttccccaccctcctccactactatcgctgagcgggctggcaaggcgcattagnnnnnnn

SEQ ID NO: 392757 - DNA, 517 bp, Homo sapiens
  misc_feature: GZ8MTXP01BLBDO.10.76.G10.1.454.CMB.2.raw
  modified_base (252)..(252): a, c, t, g, unknown or other
  modified_base (274)..(274): a, c, t, g, unknown or other
  modified_base (432)..(432): a, c, t, g, unknown or other
  modified_base (446)..(446): a, c, t, g, unknown or other
  modified_base (507)..(517): a, c, t, g, unknown or other
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataacaacaatcggccctcaggggtctctgaccgattcnctgcctcaagtctggcacttcngcctccctggtcatatctggtctccgagggtgaggatgaggctgtattatactgcccctactcctatgaaccaaacacgcctagtagttatttggcttgggttcgcgggcgggacaaggttcgaccgtctacgtcagcccaggctcgcccctggtccncgtcgtcgtccccncctcctccactacgtactcgtcgtagcggccgggtctcgggacgaggccgacgtaattcgnnnnnnnnnnn

SEQ ID NO: 392758 - DNA, 631 bp, Homo sapiens
  misc_feature: GZ8MTXP01A9LIQ.10.76.G10.1.454.CMB.2.raw
  modified_base (358)..(358): a, c, t, g, unknown or other
  modified_base (620)..(620): a, c, t, g, unknown or other
  modified_base (622)..(631): a, c, t, g, unknown or other
tcagcatagtagtgcacgaccggtgctcgatttagtcactcatacagggtcctgggcccagtctgtaccgacgcagccgccctcagtatctggggccccagggcagagggtctccatctcctgcactgggagcagaaccagcagtcggggcaggttatgatgttcattggtaccgccaggttccaggcacacgcccccagacctcctcattaatgaataacaacaatccggccctgagggtctctgaccgtattctctgccctacaagtctggctacttctcgcccttcccgtggtccattacttccgtggtcctccggaggggttacaggtatggacggtctagtactttacttacncgtaccctaccccttctatcgaaaccctaaacgacggttacccttggtaagtttacgtttcggggtccttggggttcccggggacgggtaccgggtaacctaacggttccggacccgtccttacgacgaccggaccccgaaggtccctccccgcccccgttggtacctcccgttccgttcccggtttcccccgcccttcccctacctaccttaccgtcgtcgcgtcgggaccggcgggtctcgggacagggtccagtaatgngnnnnnnnnnn

SEQ ID NO: 392759 - DNA, 482 bp, Homo sapiens
  misc_feature: GZ8MTXP02J2FCE.10.76.G10.1.454.CMB.2.raw
  modified_base (273)..(273): a, c, t, g, unknown or other
  modified_base (304)..(304): a, c, t, g, unknown or other
  modified_base (308)..(308): a, c, t, g, unknown or other
  modified_base (467)..(467): a, c, t, g, unknown or other
  modified_base (470)..(470): a, c, t, g, unknown or other
  modified_base (473)..(482): a, c, t, g, unknown or other
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctcaagtctggcacttcngcctccctggtcatatctggtctccagggtnaggntgaggctgattatactgccccactcctatgacaacagcctgagttatttgctgttcggcggcgggaccaagttcgaccgtcctagtcagcccaaggcctcgccccctggtcactctgttcccgccctcctccactacactgctgagcggctggcaggcncanagnnnnnnnnnn

SEQ ID NO: 392760 - DNA, 517 bp, Homo sapiens
  misc_feature: GZ8MTXP02FORBB.10.76.G10.1.454.CMB.2.raw
  modified_base (508)..(517): a, c, t, g, unknown or other
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggctacttctgccctccctggtcatatctggtctccgagggtgaggatgaggctgtattatactgccccactcctatcgacaacagcctgagttattggctggttcgggcggcgggactagttcgaccgtctacgtcacgcccgaacggctccgccccctcggtcctactctcgttcccgcccctcctcccactactactcgcctggacgcgggcgtcggacgaaacgggccgacgacgtagnnnnnnnnnn

SEQ ID NO: 392761 - DNA, 583 bp, Homo sapiens
  misc_feature: GZ8MTXP02G9XFM.10.76.G10.1.454.CMB.2.raw
  modified_base (253)..(253): a, c, t, g, unknown or other
  modified_base (282)..(282): a, c, t, g, unknown or other
  modified_base (292)..(292): a, c, t, g, unknown or other
  modified_base (299)..(299): a, c, t, g, unknown or other
  modified_base (321)..(321): a, c, t, g, unknown or other
  modified_base (361)..(361): a, c, t, g, unknown or other
  modified_base (487)..(487): a, c, t, g, unknown or other
  modified_base (571)..(571): a, c, t, g, unknown or other
  modified_base (573)..(574): a, c, t, g, unknown or other
  modified_base (576)..(583): a, c, t, g, unknown or other
tcagcatagtagtgcacgaccggtgctcgatttagtcactcatacagggtcctgggcccagtctgtactgacgcagccgccctcagtatctggggcccccagggcagagggtctccatctcctgcactgggagcagaaccagcagtcggggcaggttatgatgttcattggtaccgcaggttccaggcacacgcccccagacctcctcattaatgaataacaacaactcggccctcgagggtctctgaccgtnttctctcgccctcaagtctcgctacttcncgccttcccngtccatntcgtgtctcgaggtgagagtgnggtctagtattactctcgcccctactctatacgacaacgnctgtagttagttgcgttggttcgggcggtacggactaggtccgaccgtctacggactaccgacccgtaacgtcccgtcccgtcccccgtacggtcctaccgttcccgtttcccggttacccccccncccttacccctaccctacctttaacgtaccgttcggtccgtagggcggtccggggccgttcgggacgacggacgtacgagtcgngnngnnnnnnnn

SEQ ID NO: 392762 - DNA, 489 bp, Homo sapiens
  misc_feature: GZ8MTXP02FOTOY.10.76.G10.1.454.CMB.2.raw
  modified_base (349)..(349): a, c, t, g, unknown or other
  modified_base (481)..(489): a, c, t, g, unknown or other
tcagcatagtagtgcacgaccggtgctcgatttagtcactcatacagggtcctgggcccagtctgtactgacgcagccgccctcagtatctggggcccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctcccctggtcatatctggtctccagggtgaggatgaggctgattattactgccccactcctatgacaacngcctgagtatttgctgttcggcggcggacaagttgaccgtcctacgtcagcccaagctcgccccctcggtccactctcgttccccgccctcctcccactactatgctgagcgggctggcaacggcacatagnnnnnnnnn

SEQ ID NO: 392763 - DNA, 581 bp, Homo sapiens
  misc_feature: GZ8MTXP02I9N12.10.76.G10.1.454.CMB.2.raw
  modified_base (319)..(319): a, c, t, g, unknown or other
  modified_base (359)..(359): a, c, t, g, unknown or other
  modified_base (567)..(567): a, c, t, g, unknown or other
  modified_base (570)..(572): a, c, t, g, unknown or other
  modified_base (574)..(581): a, c, t, g, unknown or other
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataacaacaatcggccctcgaggggtctctgaccgtattcctctgcctcaagtctggctacttctgcctccctggtcatactcgtggtcctccgaggggtcgaggntggaggcttgtattatactgccctactcctatcgacaacngcctgtaagttgtttggcttggttcgggcggacgggtactaagttcgacccgtctacgctacgacccgaaggtccctccgcccccgttcggtccctaccgttcccgtttccgttccccccaaccccttccctaccctaaacccttcgtaacgtccggtacgttcggaaccgggcgggtaccgtcgggaccgaaacgggtcacggttancgnnngnnnnnnnn

SEQ ID NO: 392764 - DNA, 525 bp, Homo sapiens
  misc_feature: GZ8MTXP01AETKO.11.19.B08.1.454.CMB.2.raw
  modified_base (294)..(294): a, c, t, g, unknown or other
  modified_base (425)..(425): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagagttatgaaatgaactgggtccnccaggctccgaggggagggctggagtgggtttcatacatttctagtaattctggtaccccatacactatgcagtctctgtggaagggccgattcaccatctccagacgacaacgccaggaactcactttanctagacaaagtgagcagcctgagagtcgaggactacgggtatttataactgttgcgagagattgttcttgtctatcgcgttccggggatcttaacgtaag

SEQ ID NO: 392765 - DNA, 518 bp, Homo sapiens
  misc_feature: GZ8MTXP01EABCF.11.19.B08.1.454.CMB.2.raw
  modified_base (418)..(418): a, c, t, g, unknown or other
  modified_base (459)..(459): a, c, t, g, unknown or other
tcagcgagagataccacgaccggtgctcgatttagtgagtcagtaagggctcagagaggtgccttagccctggattccaaggcatttccacttggtgatcagcactgaacacagaggactcaccatggagttgggctgtgctgggttttccttgttgctatttagaaggtgtccagtgtgaggtgcaggtggtggagtcgtgggggaagcttggtacagcctggagggtccctgagactcttctgtgcagcctctggattcgactttagagttatgaaatgaactgggtccgccaggctcgagggagggctggagtgggtttcattacatttctagtaattctggtaccccatacactatgcagtctctgtgaagggccgattcaccatctccagagacaacgccaggactcacttanctgacaaagtgagcagcctgagagtcgaggtactacgggtnttagtaactgttgcgagagtattgttcttgtctagtcgtcgttccgggatcttaacgtg

SEQ ID NO: 392766 - DNA, 512 bp, Homo sapiens
  misc_feature: GZ8MTXP01BLXQI.11.19.B08.1.454.CMB.2.raw
  modified_base (418)..(418): a, c, t, g, unknown or other
  modified_base (477)..(477): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagagttatgaaatgaactggtccgcaggctcgagggaggggctggagtgggtttcatacatttctagtaattctggtaccccatacactatgcagtctctgtgaagggccattcaccatctccagagacaacgccaggactcacttanctagcaaatgagcagcctgacgagtcgagacgtacgggttatttataactgttgcgagngattagttcttgtctatgtctcgggatcttaagtg

SEQ ID NO: 392767 - DNA, 559 bp, Homo sapiens
  misc_feature: GZ8MTXP01DF0L8.11.19.B08.1.454.CMB.2.raw
  modified_base (399)..(399): a, c, t, g, unknown or other
  modified_base (425)..(425): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtggagggtccctgagactcttctgtgcagcctctggattcgtactttagtagttatgaaatgaacgtgggtcccgcaggctccgagggagggctggagtggttcatactatttctagtaattctagtaccccatacactatgacagtctctgtaggaagggccattcaccatcncagacacaacgcagtactctacttanctagacaaagtgaagcaacgcctaggagtagtaacggaggtaacgtacgggttaattttagtaactggttgacgaaggtagtattaggttcttcgttctagtcggtccttaccggggataaccgttaacttaag

SEQ ID NO: 392768 - DNA, 541 bp, Homo sapiens
  misc_feature: GZ8MTXP01EPWG9.11.19.B08.1.454.CMB.2.raw
  modified_base (432)..(432): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtggagggtccctgagactcttctgtgcagcctctggattcgactttagtagttatagaaatgaacgtgggtccgcaggctcgagggagggctggagtgggtttcatactatttctagtaattctaggtaccccatacactatgacagtctctggtgaacgggcctattcaccatctaccagacacaacgccaagaactcaactttanctagacaaagtgacgcagcctgagagtacgaggtactacgggttatttataactgttgcgttagagtattagttcttgtctagtcgtcgttccgggatcttaacgtaag

SEQ ID NO: 392769 - DNA, 537 bp, Homo sapiens
  misc_feature: GZ8MTXP01BXHC3.11.19.B08.1.454.CMB.2.raw
  modified_base (297)..(297): a, c, t, g, unknown or other
  modified_base (398)..(398): a, c, t, g, unknown or other
  modified_base (420)..(420): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtggggggaagcttggtacagcctgggagggtccctgagactcttctgtgcagcctctggattcgactttagagttatgaaatgaactgggtccncaggctcgagggagggctggagtgggtttcatacatttctagtaattctggtacccatacactatgcagtctctgtgaagggcctatcaccatctccaganacaacgccaggaactcacttanctagacaaagtgagcacgcctagagagtacggaggtactacggggttattagttaacgtgttggcgagagtattaggttcttagtctagtcgtcgttccgggatccgttaagtaacg

SEQ ID NO: 392770 - DNA, 550 bp, Homo sapiens
  misc_feature: GZ8MTXP01AMERN.11.19.B08.1.454.CMB.2.raw
  modified_base (212)..(212): a, c, t, g, unknown or other
  modified_base (296)..(296): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagccgtggagggtccctgagactcttctgtgcagcctctggattcgactttagtagttatgaaatgaactggtccncaggctcgaggaggggctggagtgggttcatactatttctagtaattctaggtaccccatacatatgacagtctcgtgtagaacgggccgtaattcaccatctaccagacgacaacgcaggactctacttatctgacaaagtgacgcacgcctgagagtacggaggtacgtacgggttaatttagttaacgtgttggcgaggagtattagttcttaggtcttagtcgtcgtttcggggatccgttaaagttaag

SEQ ID NO: 392771 - DNA, 586 bp, Homo sapiens
  misc_feature: GZ8MTXP01D916M.11.19.B08.1.454.CMB.2.raw
  modified_base (213)..(213): a, c, t, g, unknown or other
  modified_base (292)..(292): a, c, t, g, unknown or other
  modified_base (481)..(481): a, c, t, g, unknown or other
  modified_base (498)..(498): a, c, t, g, unknown or other
  modified_base (531)..(531): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancttggtacagccgtgggacgggtccctgagtactcttctgtgcacgtcctcgtgggtattcgtaacttttagtagttanagtaaatgaacgtggggtcccacgaggcctaccggagggggaaggggcttagggagttgggtttcatttactattttctaagttaattcgtacggtacccatacactatcgactagtctcgtggtagaacggggcctattccaacctatcctaccagacgaacaacgaccgaaggtactctaactttancgtagaacaaaggtgancacgctgagaggtacgagtacgtaggttatttntaacgtgttgacgagtagtattgttcttgtctatcgtcgtcgggatccttaagtg

SEQ ID NO: 392772 - DNA, 570 bp, Homo sapiens
  misc_feature: GZ8MTXP01EWR0U.11.19.B08.1.454.CMB.2.raw
  modified_base (211)..(211): a, c, t, g, unknown or other
  modified_base (300)..(300): a, c, t, g, unknown or other
  modified_base (465)..(465): a, c, t, g, unknown or other
  modified_base (524)..(524): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttcctgttgctattttagaggtgtccagtgtgaggtgcaggtggtggagtcgtgggggaancttggtacagccgtgggacgggtccctgagctcttctgtgcagcctctggattcgactttagtagttatagaaatgaacgtgggtcccncaggcctccgagggagggggctgggagttgggtttcattactatttctagtaattctggtaccccatacactatgactagtctcgtggtaggaacgggtcccgtaattccaaccctatccctaccaaggaacgaccaaacgaccgaaggtaacctctaactttanctagacaaagtgagcagcctgagagtacgagtacgtacgggttatttagtaactgacgngagagtattagttcttgtctatcgtcgttcgggatcgttaagtaag

SEQ ID NO: 392773 - DNA, 529 bp, Homo sapiens
  misc_feature: GZ8MTXP01C5KXO.11.19.B08.1.454.CMB.2.raw
  modified_base (360)..(360): a, c, t, g, unknown or other
  modified_base (425)..(425): a, c, t, g, unknown or other
  modified_base (447)..(447): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaggtgtccagtgtgaggtgcaggtggtggagtcgtgggggaagcttggtacagcctggagggtccctgagactcttctgtgcagcctctggattcgactttagtagttatgaaatgaactgggtccgcaggctccgaggggaaggggctggagtgggttcatacatttctagtaattctggtaccccatacntatgactagtctctgtggaagggcctattcaccatctcagacgacaacgcaggaactcactttanctagcaaagtgagcagctgagngtacgaggtacagggttatttagtaacgtgttgcgagagtattaggttcttgctagtcgtcttccggggatcttaacgtaag

SEQ ID NO: 392774 - DNA, 714 bp, Homo sapiens
  misc_feature: GZ8MTXP01CZLN1.11.19.B08.1.454.CMB.2.raw
  modified_base (315)..(315): a, c, t, g, unknown or other
  modified_base (502)..(502): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcgaggtggtggagtcgtgggggaagtcgttggtacagccgtgggacgggtccctgagtactcttctgtgcacgtcctcgtggtattcgtacttttagtagttatagaaatgaacgtcgggtcccncgaggcctccggagggggaacggggctgggagttgggtttcattactattttctaagttaatttcgtacggtaaccccattacattatcgaactacgtctcgtggtacgggaaacgggtccgtaattccaacctatcctaccgaagaacgaaccaaccgaccgaaggtaaacccttcttactttaanccgttagaacctaaagttcggaagtacacggtcccgtaggacggtacggtaaccgggaaggtaaccgtaacggggttttaattttaacggtttaacgttgggttacggtaccggttaaaggtaacgtaagttttacggttccgttagggtttaaccttaacggttcggttacccgggtttacgggggaaacttaacccctttaaagttaacg

SEQ ID NO: 392775 - DNA, 525 bp, Homo sapiens
  misc_feature: GZ8MTXP01AF6OU.11.19.B08.1.454.CMB.2.raw
  modified_base (245)..(245): a, c, t, g, unknown or other
  modified_base (297)..(297): a, c, t, g, unknown or other
  modified_base (408)..(408): a, c, t, g, unknown or other
  modified_base (414)..(414): a, c, t, g, unknown or other
  modified_base (509)..(509): a, c, t, g, unknown or other
tcagcgagagataccacgaccggtgctcgatttagtgagtcagtaaggggttcagagaggtgccttagccttggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttgggtacagcctgggagggtccctgagactnttctgtgcagcctctggattcgactttagtagtatgaaatgaactgggtccncaggctcgagggagggctggagtgggttcagtacatttctagtaattctggtaccatacatatgcaagtctctgtgaagggccattcacatctcagagacaacgcagactnacttanctgcaaatggagcagcctgacgagtcgaggactacggggttatttactcgtaagtggcgagagatagttcttggttcctaagtgcttccgggggnttctaacgttgtaacg

SEQ ID NO: 392776 - DNA, 547 bp, Homo sapiens
  misc_feature: GZ8MTXP01D0WRP.11.19.B08.1.454.CMB.2.raw
  modified_base (298)..(298): a, c, t, g, unknown or other
  modified_base (438)..(438): a, c, t, g, unknown or other
  modified_base (499)..(499): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatagaaatgaacgtgggtccncaggctccgagggagggctggagtgggtttcatactatttctagtaattcgtggtaccccatacactatgacagtctcgtggtagaacggggccctattcacctatctccagacaaccaacgaccaggaactctacttanctagacaaagtgagcagcctgagagtacggaggtacgtacgggttatttagtaactgttgngagagtattgttcttgtctagtcgtcgttccggggatccttaagtaag

SEQ ID NO: 392777 - DNA, 561 bp, Homo sapiens
  misc_feature: GZ8MTXP01BPLMD.11.19.B08.1.454.CMB.2.raw
  modified_base (213)..(213): a, c, t, g, unknown or other
  modified_base (446)..(446): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancttggtacagcctgggagggtccctgagactcttctgtgcagcctctggattcgtactttagtagttatagtaaatgaacgtcgggtcccgccaggctccggaggggaaggggctgggaggttgggtttcattactatttctagtaattcgtggtaccccatacactatgacagtctcgtgtaggacgggccattcacctatctcagacgacaacgccaaggactctacttanctagacaaagtgagcacgcctagagagtacggaagtacgtacgggttatttagttaacgtggttgcgagagtattagttcttgtctagtcgtcgtcgggagtaacttaacgtaag

SEQ ID NO: 392778 - DNA, 567 bp, Homo sapiens
  misc_feature: GZ8MTXP01CJY3U.11.19.B08.1.454.CMB.2.raw
  modified_base (215)..(215): a, c, t, g, unknown or other
  modified_base (301)..(301): a, c, t, g, unknown or other
  modified_base (438)..(438): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcgaggtggtggagtcgtgggggaancttggtacagccgtgggagggtccctgagactcttctgtgcagcctctggattcgtactttagagttatgaaatgaactgggtccnccaggctccgaggggagggctggagtgggtttcatactatttctagtaattctggtacccatacactatgcagtctcgtgtggaacgggcctattcacctatcaccagacgaacaacgccaaggaacctcactttanctagactaaagtgagcagcctggacgaggtcgaggtacgtagggttatttattaactgttgagagtaagatttacggttcttcgtcttagtcggtccggttacccggggattaaccgttaacgtttaag

SEQ ID NO: 392779 - DNA, 555 bp, Homo sapiens
  misc_feature: GZ8MTXP01EDK1V.11.19.B08.1.454.CMB.2.raw
  modified_base (443)..(443): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagactcttctgtgcagtcctcgtggattcgactttagtagttatgaaatgaacgtgggtccgcaggctcgagggaggggctggagttgggtttcattactatttctagttaattctaggtaccccatacactatgactagtctcgtggtaggaacgggcctattcacctatcctaccagacgacaacgccaagactcactttanctagacaagtgagcagcctgagagtacgaggtacgtacgggttatttacgtaagtgttggacgttagagtattagttcttagtctagtcgtcgttcgggatcgttaacgttg

SEQ ID NO: 392780 - DNA, 558 bp, Homo sapiens
  misc_feature: GZ8MTXP01DMQYU.11.19.B08.1.454.CMB.2.raw
  modified_base (328)..(328): a, c, t, g, unknown or other
  modified_base (509)..(509): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagactcttctgtgcagcctcgtggattcgactttagtagttatagaaatgaactgggtccgcaggctcgagggagggctggagtggttnatactatttctagtaatctgtaccccatacactatgactagtctctggtaggaacggggcccgtattccaaccctatcctaccaagacgaccaaacgcccaaggaacctctaactttatctagacaaagtgagcagcctgagagtacggagtacgtacgggttatttagttaactgttcgngagagtattaggttcttgtctagtcgcgttaccgggatccttaagtaag

SEQ ID NO: 392781 - DNA, 550 bp, Homo sapiens
  misc_feature: GZ8MTXP01AHFM0.11.19.B08.1.454.CMB.2.raw
  modified_base (442)..(442): a, c, t, g, unknown or other
  modified_base (501)..(501): a, c, t, g, unknown or other
  modified_base (509)..(509): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccgcaggctccgaggggaaggggctgggagttgggtttcagtacatttctagtaattctggtaccccatacactatgactagtctctggtgaaggggccgtattccaaccatctccaagagaaccaacgccaaggacctcaacctttanctagacaaagtgagcagcctgagagtcgaggacctacggggtatttgttaactgttcgngagaaggnttaggttcttggtctagtgtcttcggggatccttaagtaag

SEQ ID NO: 392782 - DNA, 558 bp, Homo sapiens
  misc_feature: GZ8MTXP01DY0FX.11.19.B08.1.454.CMB.2.raw
  modified_base (214)..(214): a, c, t, g, unknown or other
  modified_base (308)..(308): a, c, t, g, unknown or other
  modified_base (410)..(410): a, c, t, g, unknown or other
  modified_base (436)..(436): a, c, t, g, unknown or other
  modified_base (457)..(457): a, c, t, g, unknown or other
  modified_base (503)..(503): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcaggtggtggagtcgtgggggaancttggtacagccgtgggagggtccctgagtactcttctgtgcacgtcctcgtggattcgtaactttagtagttatagaaatgaacgtgggtccncgaggctcgagggagggctggagttggttcattactatttctagttaattcgtacgtacccatacatatgaccagtctctgtagaacgggcctatcacatcncagacacaacgacagactctatttanctagacaaagtgagcgagccngagacggtacgaggtaccgtaagggttatttagtaactggttacgngaagatgttagttcgttagttctatcggtccgtacgggataacgttaacgttaag

SEQ ID NO: 392783 - DNA, 593 bp, Homo sapiens
  misc_feature: GZ8MTXP01EUH9G.11.19.B08.1.454.CMB.2.raw
  modified_base (211)..(211): a, c, t, g, unknown or other
  modified_base (456)..(456): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtactgggttttccttgttgctatttagaaggtgtccagtgtgaggtgcgaggtggtggagtcgtgggggaancgttggtacagcctgggacgggtccctgagacttcttctgtgcagtcctcgtggtattcgtactttagtagtatagaaatgaacgtgggtccgcgaggctccgaggggagggctgggtagttgggtttacattactatttactagttaattctaggtaccactactactatgctaagttctgtgtaggaacgggtcctaattccactatcctacagacgacaacgccaaggacttctaactttanctagaactaaagtcggagacgaacgtccgtaggagagtacggaaggtacgtacgggtttaatttagtacgtggtagagaagttagtattgttacgttgttctaagtcggtcgttcgggattactaacgttgtaacgg

SEQ ID NO: 392784 - DNA, 541 bp, Homo sapiens
  misc_feature: GZ8MTXP01AUW6H.11.19.B08.1.454.CMB.2.raw
  modified_base (462)..(462): a, c, t, g, unknown or other
  modified_base (479)..(479): a, c, t, g, unknown or other
  modified_base (492)..(492): a, c, t, g, unknown or other
  modified_base (496)..(496): a, c, t, g, unknown or other
  modified_base (509)..(509): a, c, t, g, unknown or other
  modified_base (530)..(530): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagctcggtacagcctggagggtccctgagactcttctgtgcagcctctggattcgactttagtagttatgaaatgaactgggtccgcaggctccgagggaggggctggagtgggtttcatactatttctagtaattctggtacccatacactatgacagtctctggtaggaacgggccgtattccacccatcctaccagacgaccaacgccaaggaactcaactttatctagacaaagtgagcacgcctgagngtacgagaccaggattnttaatcttggtcngagngttattcgttctntctaagtcgtcgttacgggtnttaacttaacg

SEQ ID NO: 392785 - DNA, 603 bp, Homo sapiens
  misc_feature: GZ8MTXP01C6WN4.11.19.B08.1.454.CMB.2.raw
  modified_base (448)..(448): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtggaggtccctgagactcttctgtgcagcctctggattcgtactttagtagttatagaaatgaacgtgggtccgcaggctccggagggagggctaggagtgggtttcagttacattttctagttaattctacggtaacccctatacactatcgactagtctgtgtggaagggccgattcaccatcctccagacgaacaacgaccgaaggtaactctactttanctacgactaaaggtcgacgacgacgtccgaggtaacggagtaacggtacggtaaacgtacgggtttaattttacgttaagttggttacgagaggtagtagttacgttcgttattcgttatcggtccgttacgggttacttaacttaacgttaacg

SEQ ID NO: 392786 - DNA, 639 bp, Homo sapiens
  misc_feature: GZ8MTXP01DGN1B.11.19.B08.1.454.CMB.2.raw
  modified_base (213)..(213): a, c, t, g, unknown or other
  modified_base (489)..(489): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancttggtacagccgtggagggtccctgagactcttctgtgcagcctcgtggattcgactttagtagttatgaaatgaacgtgggtccgcaggctccgaggggaagggctggagttgggtttcattactatttctaagttaattcgtacggtaaccccatacactatgtacctagttccttcgttgggtacgggaaacggggtcccctatttacccgaacctattccgtaccaaggaacgaaccaaacgccgtaacgggtaaaccttctaacttttanaccgtagtaaccaaaagttggaacggacacggccctggaacgtaggttaccggaaagggtaccgtaacggggtttaatttaagttaacgtggttcggacgagaagtattaggttcttggtctagtcgtacggtcggagtaacttaacgtg

SEQ ID NO: 392787 - DNA, 588 bp, Homo sapiens
  misc_feature: GZ8MTXP01EGROT.11.19.B08.1.454.CMB.2.raw
  modified_base (530)..(530): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaaggtgtccagtgtgaggtgcaggtggtggagtcgtgggggaagcttgggtacagcctgggagggtccctgagactcttctgtgcagcctctggattcgaactttagtagttatagaaatgaacgtgggtcccgcaggctccgaggggaggggctgggagttgggttcatactatttcaagttaattctaggtacccccatacactatgactagtctctggtaggaaacggggccctaatttccaaccctattcctaccaagacgaacaaacgaccaagggtaactctaactttatctagacaaagtgaagcacgcctagagagtacgaggtactacgggtttaatttagttaacgtgttagnggagaagtattacggttcttgttaactagtcgtccgttccgggattccttaagttaag

SEQ ID NO: 392788 - DNA, 566 bp, Homo sapiens
  misc_feature: GZ8MTXP01ELDKI.11.19.B08.1.454.CMB.2.raw
  modified_base (214)..(214): a, c, t, g, unknown or other
  modified_base (345)..(345): a, c, t, g, unknown or other
  modified_base (442)..(442): a, c, t, g, unknown or other
  modified_base (446)..(446): a, c, t, g, unknown or other
  modified_base (465)..(465): a, c, t, g, unknown or other
  modified_base (503)..(503): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcaggtggtggagtcgtgggggaancttggtacagccgtggacggtccctgagactcttctgtgcacgcctcgtggtattcgtactttagtattatagaaatgaacgtgggtccgcaggcctacgaggggagggctggagttgggtttcattactntttctagtaattctgtaccccatacactatgacagttctctggtagaacgggtcctattccacctatctacagacaacacgacaagtactctattanctanacaaagtgagcacgctagngagtacgagtacgtacggttatttagtaactgttcggngttaagagtagttagttccgttagtcgttagtcggtccggttcgggagtaaccttaacgtaag

SEQ ID NO: 392789 - DNA, 701 bp, Homo sapiens
  misc_feature: GZ8MTXP01D9KSS.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttcctgttgctatttagaagtgtccagtgtgaggtgcaggtggtggagtcgtgggggaagcttggtacagccgtggagggtccctgagactcttctgtgcagcctcgtggtattcgtactttagtattatagtaaatgaacgtcgggtcccgcgaggctaccggaggggaacggggtctagggtagttgggtttacattactatttactaagttaattcgtacggtacccatacactatcgacagttctcgtggtaggaacggggcctattaccgacctactcctaccgaagacgaaccgaaccgaccctaacgggtaaccttctaaactttactactagtaacctaaaggttacgaacggaccgacgacccgttaggaacggtaacggttaccgggaaggtaaaccgtaccggggtttaaattttaacgttaacgtgggttaggtaacggttaaagtaaaggttaattaacggttccgttaggttaacctttagtaacgggttcccggttaccccgggggttaagttaaccccgtttaaaatttaaccggg

SEQ ID NO: 392790 - DNA, 607 bp, Homo sapiens
  misc_feature: GZ8MTXP01D7WLA.11.19.B08.1.454.CMB.2.raw
  modified_base (485)..(485): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaaggtgtccagtgtgaggtgcaggtggtggagtcgtgggggaagcttggtacagccgtgggagggtccctgagactcttctgtgcagcctctggattcgtactttagtagttatagaaatgaacgtgggtccgacgaggcctccggaaggggaaggggtcgtagggtaggttgggtttcaagttactagtttactaagttaaacttcgtacggtaaccccatacactatgactagttctctggtaggaaacgggtccgtattccacctagtcctaccaagacgaaccaaacgacccgaaggtaacctctaactttacnctacgaacaaaggtcgagtacacgcctagagtagtacggagtaccgtaggttatttataacgtgttgcgagtagtattaggttcttgttctagtcgtcgtaccgggataacgttaagtaacg

SEQ ID NO: 392791 - DNA, 642 bp, Homo sapiens
  misc_feature: GZ8MTXP01AOEZR.11.19.B08.1.454.CMB.2.raw
  modified_base (209)..(209): a, c, t, g, unknown or other
  modified_base (300)..(300): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctatttagaggtgtccagtgtgaggtgcaggtggtggagtcgtgggggaancttggtacagcctggacgggtccctgagactcttctgtgcagcctgtggtattcgtactttagtagttatagaaatcgaacgtgggtcccncgagggcctaccggaggggaagggggtctgggaggttgggtttacattacgtattttacgtaagttaactttcgtacggttaacccccattacgacttatgactagttctctggtaggaacgggcctaattccaaaccactcctaccgaagacgaaccaaaccgacccgaaggtaactcctaactttaactcctagacctaaagtgaagccagtcccgtggaagacggtacggaacgggtacgtaacggggtttatttaacgttaacgtggttacggacgaagtaaggtattacggttcttgttaacgtatcggtaccgttaccggggatccgttaaacttg

SEQ ID NO: 392792 - DNA, 670 bp, Homo sapiens
  misc_feature: GZ8MTXP01CFPFE.11.19.B08.1.454.CMB.2.raw
  modified_base (211)..(211): a, c, t, g, unknown or other
  modified_base (490)..(490): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaggtgtccagtgtgaggtgcaggtggtggagtcgtgggggaancttggtacagcctgggacgggtccctgagactcttctgtgcagcctcgtggattcgactttagagttatgaaatgaactgggtccgcaggctaccgaggggaggggctgggagttgggtttacatactatttctaagttaattctaggtaccccatacactatcgactagttctcgtggtacggaacggggccctaatttcccaacccgtattaccctaccccgaaaggacggaaccaaacccggacccgaaagggtaaaccttcctaaacctttttanacctacggaaccaaaagttggaacgcccgaaaggtccccgttaggaaacgggtacggttaccgggaaacggggtaccgtaaaccggggttttaattttaacggttaacccgtgggttacgacggaaggtaacgtgttacgttcttggtaactgtaacgcgttccggggatccgttaatcg

SEQ ID NO: 392793 - DNA, 670 bp, Homo sapiens
  misc_feature: GZ8MTXP01EL2EE.11.19.B08.1.454.CMB.2.raw
  modified_base (211)..(211): a, c, t, g, unknown or other
  modified_base (220)..(220): a, c, t, g, unknown or other
  modified_base (362)..(362): a, c, t, g, unknown or other
  modified_base (561)..(561): a, c, t, g, unknown or other
  modified_base (625)..(625): a, c, t, g, unknown or other
  modified_base (633)..(633): a, c, t, g, unknown or other
  modified_base (640)..(640): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttatttagaggtgtccagtgtgaggtgcgaggtggtggagtcgtggggaancttggtacngccgtgggacggtcctgagtacttcttctgtcgcacgtccttgtggtattcgtatttagtagttatagaaatgaacgtcggtcccgcgaggcctaccgggaaggggacggggtctgggtaggtttgggtttacagttacttntttacgtaagttaattcgtacgtaacccccagtaccaacgttagtcgtaacctaaggttccttcgtacgggtacgggtaaacggggcccttaattacccaaaccctagtttacccaaaccggaagggaacccttaaaccgaaacccgtaccgaaaggttaacctccttaacttatctaacggaactaaaggtgacgacnccggtagtaggacggtagtaccggaaggtaccgttaaggttatttacgtgtgagagttagagtnttacgttnttacgtntagtcgttcggcggttataacttcgtaagg

SEQ ID NO: 392794 - DNA, 707 bp, Homo sapiens
  misc_feature: GZ8MTXP01B7XWJ.11.19.B08.1.454.CMB.2.raw
  modified_base (213)..(213): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcgaggtggtggagtcgtgggggaancgttggtacagccgtgggagggtccctgagactcttctgtgcagcctcgtggattcgtactttagtagttatagaaatgaacgtcgggtccgccgaggcctccggaggggaaggggctagggagttgggtttcaattactatttctagttaattctaggtaccccatacactatgactagtctcgtggtaggaaacggggtccgtattcccgaaccctattccctaccgaaggaacgaacccaaaccggaccccgtaaagggtaaacccttacctaacttttactcgtacggtaaaccaaaaggttggaacggtaccaaaccgggtcccttaaggggaacggtacgggttaccgggaaaggtaacccgggttaacggggtttaaattttacgttaaccgtggttggacggttaaggtaacgtagtttacggttcttacggttcgtagttcgggttccgggttacccggggaagtaaccctttaaacgttaaggg

SEQ ID NO: 392795 - DNA, 742 bp, Homo sapiens
  misc_feature: GZ8MTXP01DRDGF.11.19.B08.1.454.CMB.2.raw
  modified_base (658)..(658): a, c, t, g, unknown or other
  modified_base (666)..(666): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgctatttagaagtgtccagtgtgaggtgcaggtggtggagtcgtgggggaagtcttggtacagccgtgggacgggtccctgacgtaccttcttcgtgtcgacgaccgttccgtcgtaggttacgttacgttaagtttagtagttaagtaagtaagtaacgtacggtccgggtccccgacggtacggtaccgtacggggaagggggtacggtcggtaagggttagggtttcggtttataacgtttaactttcgttttaagttaaacgtttacttcgttaaccgtaaaccctactaactacttacgtcgaacgttacgttcgtcgttagggaacgggtaccgggtacttactaccgaaacctcttacccgaacgaaggaaccaaccgaaccgacgtaacgtaacctctttaattacacgaacaaacgtaaggtacgacgtacgtaccgtacgtaaggacgacggttaaacgacggttaaccggttacgtttaatttaaacgnggttacgngggtaaacgagtaagtcttacgttgttaccttgtaacgtcgttaacccgggtgttaaacttaacgttaagttaacg

SEQ ID NO: 392796 - DNA, 638 bp, Homo sapiens
  misc_feature: GZ8MTXP01CHWK0.11.19.B08.1.454.CMB.2.raw
  modified_base (214)..(214): a, c, t, g, unknown or other
  modified_base (311)..(311): a, c, t, g, unknown or other
  modified_base (492)..(492): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcaggtggtggagtcgtgggggaancttggtacagccgtgggacgggtccctgagtacttcttctgtgcacgcctcgtggtattcgtactttagtagttatagaaatgaacgtcgggtcccncgaggcctccggaggggaggggctgggagttgggtttcagttactattttctaagttaacttcgtacggtaaccccctatactactatcgacctagttcctacgttagggtaggaacggggcctacttccacctatccgtaccaagacgaaccaacggtaccaaggtaacctctaactttnactagactaaaggtcgaacgcaccgcgtaggacgtacggtacggaacggtacgttaacggggtttatttacgtaacgttggttggacgttagtagtattcgttcttgttctagtcgtccggttaccgggattaacttaacgtaacg

SEQ ID NO: 392797 - DNA, 545 bp, Homo sapiens
  misc_feature: GZ8MTXP01CH2F4.11.19.B08.1.454.CMB.2.raw
  modified_base (298)..(298): a, c, t, g, unknown or other
  modified_base (432)..(432): a, c, t, g, unknown or other
  modified_base (443)..(443): a, c, t, g, unknown or other
  modified_base (487)..(487): a, c, t, g, unknown or other
  modified_base (496)..(496): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaagcttggtacagcctggagggtccctgagactcttctgtgcagcctctggattcgtactttagtagttatgaaatgaactgggtccncaggctccgagggagggctggagtgggtttcatactatttctagtaattctaggtaccccatacatatgctagtctctgtaggaacgggcctattcacctatctccagacgacacgaccaggaactcactttanctgacaaagtnagcagcctgagagtcgaggtacgaggtatttagtaacgtgttgngttagagtnttagttcgttgtctagtcggtccgttacgggacgtaacttaacgttaag

SEQ ID NO: 392798 - DNA, 523 bp, Homo sapiens
  misc_feature: GZ8MTXP01D7UR7.11.19.B08.1.454.CMB.2.raw
  modified_base (211)..(211): a, c, t, g, unknown or other
  modified_base (420)..(420): a, c, t, g, unknown or other
  modified_base (478)..(478): a, c, t, g, unknown or other
  modified_base (484)..(484): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttgggtacagcctggagggtccctgagactcttctgtgcagcctctggattcgactttagagttatgaaatgaactgggtccgccaggctccgagggaggggctggagtgggtttcatacatttctagtaatctggtacccatacactatgcagtctctgtgaagggccgattcacatctccagagacaacgcaaggaactcacttanctagacaaatcgaagcaagcctgagagtacgaggtacacgggttattataactgttgngagagnttaggttcttgtctatcgcttcggggatcttaacgtaag

SEQ ID NO: 392799 - DNA, 608 bp, Homo sapiens
  misc_feature: GZ8MTXP01DN2TN.11.19.B08.1.454.CMB.2.raw
  modified_base (213)..(213): a, c, t, g, unknown or other
  modified_base (339)..(339): a, c, t, g, unknown or other
  modified_base (553)..(553): a, c, t, g, unknown or other
  modified_base (565)..(565): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaggtgtccagtgtgaggtgcaggtggtggagtcgtgggggaancgttggtacagccgtgggacggtccctgagtacttcttcgtgtgcacgtcctcgtggtacttcgtatttagtagttaatagaaatgaacgtcgggtcccgcaggcctcggaaggggagggctaggngttggtttacatttactattttactaagttaacttcgtacggtaaccccattacactatgaactagttctcgtaggtacggacgggtcctattcacctatcctacagacgaaccaacgaccgaagtactactacttacactagaactaaagtcgaagacgacgcctaggacgaggtaccggaaggtaaccgtaagggtttatttagtaacgtgnggagaagtagtnttagttcttgtctagtcgtccgtacggataacgttaagtaacg

SEQ ID NO: 392800 - DNA, 652 bp, Homo sapiens
  misc_feature: GZ8MTXP01A4V2C.11.19.B08.1.454.CMB.2.raw
  modified_base (475)..(475): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcgagggtggtggagtcggtagggggaatcgttggtacagccgtgggacgggtccctggagtacttcttcgtgtgcacgtcctcgtggtattcgtactttagtagttatagaatgaacgtgggtccgcaggctccggaggggaggggctggaggttgggtttacagtactatttctaagttaattcgtaggtaaccccatacactatgactagtctcgtggtaggaacggggcctattcacctatcctaccagacgaaccaacgaccaggtaacctctaactttcncttacgaactaaaggtgacgtaccgacgtaccgtaggaacggtacggtacggaacggtacgttaacggtttaattttaacgtcgtggttcggacgaggtaacgtagttacgttcttacggtcttacggtccggtttaccgggttaccgggttaacgttaaccgtttaacgttaaggg

SEQ ID NO: 392801 - DNA, 572 bp, Homo sapiens
  misc_feature: GZ8MTXP01CKSHA.11.19.B08.1.454.CMB.2.raw
  modified_base (213)..(213): a, c, t, g, unknown or other
  modified_base (304)..(304): a, c, t, g, unknown or other
  modified_base (454)..(454): a, c, t, g, unknown or other
  modified_base (514)..(514): a, c, t, g, unknown or other
  modified_base (526)..(526): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancgttggtacagccgtgggagggtccctgagactcttctgtgcagcctctggattcgactttagtagttatagtaaatgaacgtgggtcccncgaggctccgaggggagggcgtgggagttgggtttcattactattttctagttaattcgtagtacccctatactactatgactagttctcgtgtaggaacgggcctattcacctatctaccagacgacaaccgcaacggactctacttanctagactaagtcgagcaacgcgtgagagtacggagtacgtacgggttatttgtaactggngacgagtaagtnttacgttcttgttctagtcgtcgttccgggatccgttaagttaacg

SEQ ID NO: 392802 - DNA, 589 bp, Homo sapiens
  misc_feature: GZ8MTXP01EIQ1A.11.19.B08.1.454.CMB.2.raw
  modified_base (311)..(311): a, c, t, g, unknown or other
  modified_base (461)..(461): a, c, t, g, unknown or other
  modified_base (557)..(557): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttattttagaaggtgtccagtgtgaggtgcagggtggtggagtcgtgggggaatcttgggtacagccgtgggacgggtccctggagtacttcttctgtgcacgtcctcgtggtattcgtactttagtagttatagaaatgaacgtggtccncgaggctcgagggagggctggagtggtttcattactatttctaagtattctagtacccatacactatcgacagttctcgtggtacggaacggggtcctattcacctacgtctaccagacaaccaacgacctaaggtaactctactttacncttagactaaagtcgagcacgctaggagtacggtacgaacgtacggtaacggtttatttacttaagtgttggacgagtagtagttagttcttagtntagtcgtccttcgaggtaacgttaacgttaac

SEQ ID NO: 392803 - DNA, 722 bp, Homo sapiens
  misc_feature: GZ8MTXP01EQ7J1.11.19.B08.1.454.CMB.2.raw
  modified_base (289)..(290): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttatttagaaggtgtccagtgtgaggtgcaggtggtggagtcgtgggggaagcttggtacagccgtggagggtccctgagactcttctgtgcagcctctggattcgactttagtagttatagaaaagtnnacgtcggtccggtaccgtacggacgtaccggacgggacggggtacggtaggtaggttaggtttacgttacgttaacgttaccgtttacgtttagttaagtttacgttacgttaaacctaacttaactaactaacgttacgtacgtacgtacgttacgtacgtacggtaacggtaccggtacgtacgtaacctaaccttacctaccgtaacgaacgaaaccgaaaccgaaccgtaaaccgtaaaccgtaaccgttaactttaacttacgtacgtaacgtaaacgtaacgaacgtacgacgtaccgtacgtaacggtaacggtaacggtaacggttaaacggtaacgggtttaaacggtttaaacgtttaacgttacgttacggttacggtaagtagtaacgttacgttacgttacgttaacgttaacgtaacg

SEQ ID NO: 392804 - DNA, 565 bp, Homo sapiens
  misc_feature: GZ8MTXP01D8MOE.11.19.B08.1.454.CMB.2.raw
  modified_base (210)..(210): a, c, t, g, unknown or other
  modified_base (258)..(258): a, c, t, g, unknown or other
  modified_base (451)..(451): a, c, t, g, unknown or other
  modified_base (505)..(505): a, c, t, g, unknown or other
  modified_base (511)..(511): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaggtgtccagtgtgaggtgcaggtggtggagtcgtgggggaancttggtacagccgttgggagggtccctgagactcttctgtgcagcctntggattcgactttagtagttatagaaatgaacgtgggtcccgcgaggctccgaggggaaggggctgggagttgggtttcagttacattttctagttaacttcgtacggtaccccatacactatgactagtctctggtacgaaggggcctattcacctatcctcagacgacaacgccaagaactctaactttanactagacaaagtcgagacgacgcctagagagtacggagtaccgtagggttattnttaacngttgagagtgtaattggttcttggtctatcgtcgttcgggataacttaagtaag

SEQ ID NO: 392805 - DNA, 692 bp, Homo sapiens
  misc_feature: GZ8MTXP01AD8WB.11.19.B08.1.454.CMB.2.raw
  modified_base (305)..(305): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaggtgtccagtgtgaggtgcagggtggtggaggtcgtggggggaagtcgttgggtacaggccgtgggacgggttcccctggacgtaccttctttcgtgtgcacggtccttcgtgggtattcgtacttttagtagttanagtaaatgaacgtggtccgcaggctcgagggagggctggagtggtcattactatttctaagtattcgtacgtacccatacactatgactagttctcgtggtagggaaacggggcctattccaacctattccctaccgaagaacgaaccgaacgtacccgaaacggtaacctcctaacttttagccttagaacctaaaggtcggaacgtcgaacgtccgtaggacgtaacgggtaccgggaacggtaccggttaacggggtttaattttaacgttaacgtgggttcggaacgttaaggtaaagttaacgttcgttccgttaggtttcccttaaggttccggggttacccggtttacccgggggttattaaccctttaaaacggttcgg

SEQ ID NO: 392806 - DNA, 515 bp, Homo sapiens
  misc_feature: GZ8MTXP01EVFDA.11.19.B08.1.454.CMB.2.raw
  modified_base (212)..(212): a, c, t, g, unknown or other
  modified_base (303)..(303): a, c, t, g, unknown or other
  modified_base (371)..(371): a, c, t, g, unknown or other
  modified_base (396)..(396): a, c, t, g, unknown or other
  modified_base (415)..(415): a, c, t, g, unknown or other
  modified_base (461)..(461): a, c, t, g, unknown or other
  modified_base (468)..(468): a, c, t, g, unknown or other
  modified_base (483)..(483): a, c, t, g, unknown or other
  modified_base (489)..(489): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgctattttagaaggtgtccagtgtgaggtgcaggtggtggagtcgtgggggaancttggtacagccgtgggacgggtccctgagactcttctgtgcagtcctgtggtattcgtactttagtagttatagaaatgaacgtggtccncaggctcgaggaggctggagtggttcatactattctagtatctagtacccatacactatgacagtctntgagaacggctatcacatcacaganacacgaccagactctattnctagacaaagtgagcaagctgagagacgagtacgtaggtattagtntgttagngagagtattacgttnttagtntgtcgtcgtacggataacgttaagtg

SEQ ID NO: 392807 - DNA, 629 bp, Homo sapiens
  misc_feature: GZ8MTXP01DP0UL.11.19.B08.1.454.CMB.2.raw
  modified_base (215)..(215): a, c, t, g, unknown or other
  modified_base (347)..(347): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcagggtggtggagtcgtgggggaancttgggtacagccgtgggacgggtccctgagtactcttctgtgcagtcctctggtattcgtactttagtagttatagaaatgaacgtggtccgcaggctccgagggaggggctggagtggtttcagttactntttctagtaattctgtacccatacactatgactagtctctggtaggaaagggtccgtattcaacctactcctaccaggaacgacaaccgaccgaacggtaactactactttacgtactagacaaaagttgaacgccgaacgccgtgaacggtaggtacggaaaggtacgtaacggggttatttacgttaacgtgggttgacggaggtaaagtagttaagttcgttacggttccttaagtccgggttccgttaccggggacgtaacctttaaacgttaaccgg

SEQ ID NO: 392808 - DNA, 831 bp, Homo sapiens
  misc_feature: GZ8MTXP01BNUYI.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcgaggtggtggagtcgtgggggaagcgttggtacagccgtgggacgggtccctgacgtactcttcgtgtgcacgtcctcgtggtattcgtactttaggtagttatagtaaatggaacgtcggggtcccgtccgaggtccgtaccgggaagggggaacgggggtcgttagggggtaagggtttcgggggttttaccaacgtttaacgttaagtttttaccgttaaaggtttaaactttccggttaacggttaaacccccctaaattaacctaacgttaagtcgtaaccctaacgtttccgtcgttgggttacggggacggggtcccgttaatttacccgaaccctacttcccgtaacccaaggaacgaaacccgaaacccggtacccgaaacggtaaacctttaccttaaaccttttactacgttaacggaaaccttaaaaggtacggtaacggaccgtaacggtacccgttaagggaacggtacggggtaaccgggtaaggtaaccgggttaaacgggtttaattttaacggttaacggttaggttaccggtacggaaggtaagttaagttacggtttcttacggttcttaacggttcgtacccgggtttacggggaacttaacccgttaaacgttaacgg

SEQ ID NO: 392809 - DNA, 636 bp, Homo sapiens
  misc_feature: GZ8MTXP01BH1V1.11.19.B08.1.454.CMB.2.raw
  modified_base (481)..(481): a, c, t, g, unknown or other
  modified_base (510)..(510): a, c, t, g, unknown or other
  modified_base (517)..(517): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcgaggtggtggagtcgtgggggaagtcttggtacagccgtgggagggtccctgagacttcttctgtgcacgtcctcgtggtattcgtactttagtattatagaaatgaacgtcgggtccgcgaggctaccggaggggagggcgtgggtaggttgggtttacagttactatttactaagttaacttcgtacgtaacccatacactatcgactagttctcgtaggtacgaacgggtcctattaccacctatcctaccgagacgaacaacggcccaaaggtactactaatttacnctagaacaaagtgaaacgcgtacgaccgngaacggngttaccgggaaggtaccgtaagggtttatttaagtcgtaggttcggaggttagtaagtagtttacgttctttagtcttaggtcgttacccgggttccgggaataaccgttaacgttaag

SEQ ID NO: 392810 - DNA, 758 bp, Homo sapiens
  misc_feature: GZ8MTXP01AZ3KK.11.19.B08.1.454.CMB.2.raw
  modified_base (308)..(308): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaggtgtccagtgtgaggtgcgaggtggtggagtcgtagggggaatcgttggtacaggtccgtgggacgggttccctaggagtaccttcttcgtggtcgcacgtcctcgtgggtatttcgaacttttaggtaagttaanagtaaaatgaaaccgtcggggtcccgaccgaggccgtaccggaagggggaaggggcgttagggtaggttgggtttacaattaacgtattttacgtaagttaacttcgtacggtaacccctatactacttatcgactagttctcgtaggtacggtaacgggtcctatttaccaacctacgtcctacgaagacgaaaccgaaccgacccgaacggtaaacttcctaaactttacgtactagaaacctaaaagttcggaacgaccgtaacggtcccgtaaggacggtaacggtaaccgggtaacggtaaacccggttaacggggttttaattttaacggttaaccgttgggttacgggtaacggaaaggtagggtaatttcggttcgttacggttaacgttaacgttcggttacccgttaccgggggttacttaaccgtttaaacgttaacgg

SEQ ID NO: 392811 - DNA, 605 bp, Homo sapiens
  misc_feature: GZ8MTXP01CBWF0.11.19.B08.1.454.CMB.2.raw
  modified_base (471)..(471): a, c, t, g, unknown or other
  modified_base (538)..(538): a, c, t, g, unknown or other
tcagcgagagataccacgaccggtgctcgatttagtgagtcagtaaggggctcagagaggtgccttagccctggattccaaggcattttccacttggtgatcagcactgaacacagaggactcaccatggagttgggctgtgcttgggttttccttgttgcttattttagaaggtgtccagtgtgaggtgcaggtggtggagtcgtgggggaagcttggtacagccgtgggacgggtccctgagacttcttctgtgcacgtcctcgtggtatttcgtacttttagtagttatagaaatgaacgtggtcccgcaggctacggagggagggctggagttggtttcatactatttctagtattctaggtacccatacactatcgactagttctcgtggtacggaacgggtcccgtattaccaacctattcctaccgaagacgaacaaccgaccaaggtaacctcttaatttacncttagactaaagtgagaccagcctgagacgtacggaagtaaccgtagggttatttacgtaacgtggngtcgaagtaagtagttacgttcttagttctagtcggtaccggttacgggactaacgttaacgtaacg

SEQ ID NO: 392812 - DNA, 600 bp, Homo sapiens
  misc_feature: GZ8MTXP01AZM2K.11.19.B08.1.454.CMB.2.raw
  modified_base (368)..(368): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtggagggtccctgagactcttctgtgcagcctcgtggtattcgacttttagagttatagaaatgaacgtgggtccgcgaggctaccgagggagggctggagtggttcatactattctagtaacttctagtacccatacactancgacagtctctggtacggaacgggcgtattccaacctattccaccaagacgaacccgaaacgacccaaacgggtaacctccttaactttacgtctaggacctaaacgtggaacgcaacgtcctggaacggtcggtaacggaaggtaccgttaagggttaattttacgaagttgacgacgagagtattacgttcttgtaacttagtcgtccggtacggacgtcttaacgtaag

SEQ ID NO: 392813 - DNA, 614 bp, Homo sapiens
  misc_feature: GZ8MTXP01BC0VL.11.19.B08.1.454.CMB.2.raw
  modified_base (173)..(173): a, c, t, g, unknown or other
  modified_base (210)..(210): a, c, t, g, unknown or other
  modified_base (497)..(497): a, c, t, g, unknown or other
  modified_base (508)..(508): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtntccagtgtgaggtgcaggtggtggagtcgtgggggancgttggtacagcctgggagggtccctgagacttcttcgtgtgcagtcctcgtggtattcgactttagtagttatagaaatgaacgttcgggtcccgcaggcctaccggaagggggaagggggctggggtagttggggtttacagttactattttactaaggttaacttcgtaggtaacccccatacgtactagtgacctagtctctagggtagaacgggcctattaccaccgtattccgaccaagaacgtaacaacgaccgtaagtaacctctaactttcgcttaanacaagtcgacncagcctaggagtacgtacggacgtaacggtaggtttaatttgtaagtgagacaggtaagtagttgttcttgtaactcgtcgttaccggtcggactaacgttaagtg

SEQ ID NO: 392814 - DNA, 618 bp, Homo sapiens
  misc_feature: GZ8MTXP01DM7YR.11.19.B08.1.454.CMB.2.raw
  modified_base (211)..(211): a, c, t, g, unknown or other
  modified_base (402)..(402): a, c, t, g, unknown or other
  modified_base (506)..(506): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctatttagaaggtgtccagtgtgaggtgcgaggtggtggagtcgtgggggaancttggtacagccgtgggacgggtccctgagtactcttctgtgcagcctcgtggattcgactttagtagttatagaaatagaacgtggtcccgcgaggcgtccgaggggaaggggcgtggtaggttgggtttctattaactatttacttaagtaattcttacggtacccactacactatcgactagtcgttntggtaggaacgggccgtacttccacccgacttccacccgaaggaacgaaccaaccgacccgaaggtaaaccttctacctttaagtctagaaccaaagttacggngaccacgcctagagtagtacggaagtacgtaacggttatttaataacgtgttgacgaggtactagttagttcgttgtcctagttcgccggttacgggataaccttaagttcg

SEQ ID NO: 392815 - DNA, 561 bp, Homo sapiens
  misc_feature: GZ8MTXP01CACGJ.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagccgtgggagggtccctgagactcttctgtgcagcctctggtattcgtactttagtagttatgaaatgaacgtgggtccgccaggctccgagggaggggcgtggagtgggttcatcatttctagtattctggtaccccatacactatgacacgtctctgtgagggccgtatcgacccatctccagacgaacaaccgaccgacggaaactctaacttactactgacaaagtcgagtcaacgcctgacgaggtcggaggacgtacggttagtttattaacgtgttagcggagagtagttagttcttgtcttagtcgtcgttcgggggactcgttaacgttaag

SEQ ID NO: 392816 - DNA, 662 bp, Homo sapiens
  misc_feature: GZ8MTXP01CMZH4.11.19.B08.1.454.CMB.2.raw
  modified_base (312)..(312): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcgaggtggtggagtcgtgggggaagtcgttggtacagccgtgggacgggtccctgagtactcttctgtgcagtcctcgtggtattcgtactttagtagttatagaaatgaacgtcgggtccncgaggcctacggaggggaggggcgtagggtaggttgggtttacattactattttcgtaagttaattcgtacggtaacccctatacacttagtcgtaactacgttctacgttaggtacgggtaaacgggtcctaacttacccaaacccttatccctaaccgaaggaaccgaaccgaaaccgacccgaaaggtaacccttacgttaactttactcgtagaactaagggtgacgacagccgtaggacgacggtacggaaggtacgtacggtttatttacgtcgtggttacgagagtaagtgttacgttcttagtaatagtcggtcggttaccgggataaccgttaagtaacgg

SEQ ID NO: 392817 - DNA, 624 bp, Homo sapiens
  misc_feature: GZ8MTXP01CZYRF.11.19.B08.1.454.CMB.2.raw
  modified_base (310)..(310): a, c, t, g, unknown or other
  modified_base (371)..(371): a, c, t, g, unknown or other
  modified_base (380)..(380): a, c, t, g, unknown or other
  modified_base (459)..(459): a, c, t, g, unknown or other
  modified_base (574)..(574): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaggtgtccagtgtgaggtgcgaggtggtggagtcgtgggggaatcgttggtacagccgtgggacgggtccctgagtacttcttctgtgcacgtcctcgtggtattcgtactttagagttatagaaatgaacgtgggtccncaggctcgagggaggctggagtggttcatacatttcagtaattctaggtacccatacatangacagtctntggtaggaaacggggcctaattccaacctatcctaccaaggaacgaaccaaaccgcctaaggtaacctactaactttancgttagaacctaaaggtcgacggacacggtaccgtaggaaggtacggtaacggaacgggtaacccgtaacggggtttattttaacgtaacgttggttacggtacgaggtaaggtnttaaggttcttggtaactagtcgtcgttaccgggataacgttaacgtaag

SEQ ID NO: 392818 - DNA, 594 bp, Homo sapiens
  misc_feature: GZ8MTXP01DBZXF.11.19.B08.1.454.CMB.2.raw
  modified_base (290)..(290): a, c, t, g, unknown or other
  modified_base (396)..(396): a, c, t, g, unknown or other
  modified_base (447)..(447): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcaggtggtggagtcgtgggggaagtcgttggtacagccgtgggacgggtccctgagacttcttctgtgcacgtcctcgtggtattcgtatttagagttanagaaatgaacgtcgggtccgcaggctacggagggaggggctggtagtgggtttacattactatttactagttaattcgtacgtacccatacatatgaactagtctntggtagacggctatcacatcacgagacgacaacgacaacgtactcacttantacgactaaagtcggaatacgacgcgtaggaacgagggtaccgaaggtaaccgttaacgggttatttaacgttaactggttacgagagtaagtattagttcgttagtaactagtcgttacggtacggttactaacgttaacgtaacg

SEQ ID NO: 392819 - DNA, 660 bp, Homo sapiens
  misc_feature: GZ8MTXP01AVV5F.11.19.B08.1.454.CMB.2.raw
  modified_base (516)..(516): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgtcttgggttttccttgttgcttattttagaggtgtccagtgtgaggtgcgagggtggtggaggtcggtaggggggaagtcgttgggtaacacggtcccgttggggacgggttcccctaggacgtaccttctttcgtggtcgcacgtcccttgtgggtattcgtaactttagtagttatagtaaatcgaacgtggggtccccacgacggcctaccgggaagggggaacggggtcgtaggggagttgggggtttacagtttactatttactaagttaattcgtaggtacccatacactatgactatcgtgtggtaggaacgggcgtacttaccacactctaccagacgacaacgacaacgtactctacttatctanaactaagcgagtacaacgcgtaggacgtaggacggaagtaaccggttacggttaattttagtaacgtggttacggagttaagacgtattacgttcgttagtaacttagtcggtccggttcggggacttaacgttaacgttaacg

SEQ ID NO: 392820 - DNA, 589 bp, Homo sapiens
  misc_feature: GZ8MTXP01ACA69.11.19.B08.1.454.CMB.2.raw
  modified_base (262)..(262): a, c, t, g, unknown or other
  modified_base (282)..(282): a, c, t, g, unknown or other
  modified_base (299)..(299): a, c, t, g, unknown or other
  modified_base (333)..(333): a, c, t, g, unknown or other
  modified_base (337)..(337): a, c, t, g, unknown or other
  modified_base (361)..(361): a, c, t, g, unknown or other
  modified_base (426)..(426): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttattttagaaggtgtccagtgtgaggtgcaggtggtggagtcgtgggggaatcttggtacagccgtgggacgggttccctgagtctcttctgtgcagcctntggtattcgatttagattangaaatgaacgtggtccncaggctcgagggagggctggagtggttcatactntttntagtatcgtcgtaccatacactancgacagtctctggtagaacggccgtattcacatcacagacaactacgaccgaagactctacttanctagacaaagtgacgcacgtcctaggacgacgttacggaacggtaacgtaacgggtttattttaagttaacgtggttacggacggttaaggaacgtaattacggttcgttagttaaccgttagttcgggtccgtttaccggggagtaaccctttaaacgtaag

SEQ ID NO: 392821 - DNA, 589 bp, Homo sapiens
  misc_feature: GZ8MTXP01ECTRK.11.19.B08.1.454.CMB.2.raw
  modified_base (306)..(306): a, c, t, g, unknown or other
  modified_base (340)..(340): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttattttagaggtgtccagtgtgaggtgcgaggtggtggagtcgtgggggaatcttggtacagccgtgggacgggttccctgagtacttcttctgtgcagtccctgtggtattcgtatttagtagttatagaaatgaacgtggccncaggctcgagggaggctggagttggttcatactntttcagtatctagtacccattacattatcgactagttctcgtaggtcggaaacgggtccctattccacctatcctaccgaagacgaaaccgaacgacccgaagtacctaccttaattactctagaactaaaggtgacgacacgtcaggagagttaccgaggtaaccgtaggttatttataactggttacgagttaagagtattaggttcttgtctgtcgtccggttacgggataacccgttaagtaacg

SEQ ID NO: 392822 - DNA, 515 bp, Homo sapiens
  misc_feature: GZ8MTXP01DBNLI.11.19.B08.1.454.CMB.2.raw
  modified_base (329)..(329): a, c, t, g, unknown or other
  modified_base (399)..(399): a, c, t, g, unknown or other
  modified_base (403)..(403): a, c, t, g, unknown or other
  modified_base (410)..(410): a, c, t, g, unknown or other
  modified_base (419)..(419): a, c, t, g, unknown or other
  modified_base (422)..(422): a, c, t, g, unknown or other
  modified_base (424)..(424): a, c, t, g, unknown or other
  modified_base (427)..(427): a, c, t, g, unknown or other
  modified_base (429)..(429): a, c, t, g, unknown or other
  modified_base (433)..(433): a, c, t, g, unknown or other
  modified_base (436)..(436): a, c, t, g, unknown or other
  modified_base (438)..(438): a, c, t, g, unknown or other
  modified_base (467)..(467): a, c, t, g, unknown or other
  modified_base (469)..(469): a, c, t, g, unknown or other
  modified_base (480)..(480): a, c, t, g, unknown or other
  modified_base (483)..(483): a, c, t, g, unknown or other
  modified_base (485)..(485): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggaggggtccctgagactcttctgtgcagcctctggattcgatttagagttatgaaatgaactggtccgcaggctccgaggaaggggctggagtgggttcatanatttctagtaatctgtaccccatacataatgcagttctctgtagaaggggccattcaccatctcagaganaaancacgaanctacttatntananaananaganacncngagagagagagagtagttattaatgttgngngagattagttnttntntatgtcgtcggttacgtaacgttaagtaag

SEQ ID NO: 392823 - DNA, 703 bp, Homo sapiens
  misc_feature: GZ8MTXP01DLAZX.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttattttagaggtgtccagtgtgaggtgcgaggtggtggagtcgtgggggaatcgttggtacagccgtgggacgggtccctagagtacttcttctggtgcacgtcctgtggtacttcgtaactttagtagttatagaaatgaacgtcgggtcccgacgacggcctaccggaagggggaacgggggtcgttagggtaggtttcggggtttacagtttaactattttcgtaaaggtttaattcgtacggttacccaattacgtacttagtcgaactacgttcgtcgtggtacgggaacgggccgtattaccacctattccgaccgaagacgaaccaaacgaccgtaaggtaaccttacgtacttaactcgtaagtaacctaaaggtcgaacggaacctacggaccgtagggacggtaggttaaccggaacgggttaaacgttacgggttaatttttaaacgtgttagggttacgacggttaagtagtaagtttacgttcgttagtcgtagttcggtcggttacggaacgttcttaagttaaccgg

SEQ ID NO: 392824 - DNA, 548 bp, Homo sapiens
  misc_feature: GZ8MTXP01CLKYY.11.19.B08.1.454.CMB.2.raw
  modified_base (399)..(399): a, c, t, g, unknown or other
  modified_base (427)..(427): a, c, t, g, unknown or other
  modified_base (503)..(503): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagagttatagaaatgaacgtgggtccgcaggctcgagggaaggggctggagtgggtttcagttacatttctaagtaattctggtacccatacactatgacagtctctgtgaacggccgattcaccatcnccagacgacacgcaggaactcactttanctgacaaagtgagcagcctgagagtcggaaggtacgtaacggggttatttagttaacgtggttagcgttagaagtnttagttcttggtctatcggtcgttccggggataaccttaagtaag

SEQ ID NO: 392825 - DNA, 704 bp, Homo sapiens
  misc_feature: GZ8MTXP01AL3ML.11.19.B08.1.454.CMB.2.raw
  modified_base (215)..(215): a, c, t, g, unknown or other
  modified_base (313)..(313): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgcttattttagaaggtgtccagtgtgaggtgcaggtggtggagtcgtagggggaancttggtacagccgtgggacgggtccctgagtactcttcgtgtgcacgtcctcgtggtacttcgtactttagtagttatagaaatgaacgtcggtcccncgaggccgtacggaaggggagggctagggtaggttcgggtttacattacttattttacgtaagttaacttcgtacggttaaccccatacaactatcgaactacgtctcgtagggtacgggaacgggtcctattaccaaccctactaccgtacccgaaaggaaccgaaccgaaacccggtacccgtaaacgtaaaccttccttaaacttttactacgttacgaaactaaacgggtcggaacgtccgaacggtccgtaggaaacggtacggtaacggtagggtaccgttaacgggtttatttaggtaacgtgttcggaacgaggtaagttgttacgttcgttcgttaactgtcggttaccggttaccgggttaactccgtttaaacgtaacgg

SEQ ID NO: 392826 - DNA, 813 bp, Homo sapiens
  misc_feature: GZ8MTXP01ANCP3.11.19.B08.1.454.CMB.2.raw
  modified_base (204)..(204): a, c, t, g, unknown or other
  modified_base (247)..(247): a, c, t, g, unknown or other
  modified_base (311)..(311): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctggttttcctgttgctatttagagtgtccagtgtgagtgcaggtggtgagtcgtgggggaancttggtacagtccgtggacgggtccctgagcttcttcgtgtcncacgtccttcgtggtacttcgtactttaggtagttatacgtaaagtcggaacgtcgggtacccncgaggtccgtccggaaggggaagggtctagggtaggttacgggtttcaagtttaccttagtttaccgtaagtttaaacgtttccgtacggttaacccccaataccgtaattaacgtcgtaaccgtacggttccgttaaccgtggggtacggaaaaccggggtccctaattccccaaaccctacggtccccttaaccgaaagggaccaaacccgaaacccggttaccccgtaaagggttaacccttaccgttaaaccgtttagttaccacgggttaaaccaaagggttggaaaccgcgaacgttcccggtaggaaggtacggtaaccccgggtaaggtaaccccgggttaaacggggttttaactttaaggtttaacccgggtacgggttacgggtaaccggttaaggtaaagttaacccgtttacgtttaccgttccggttaacgtacggttccggttaacccgggttaccggggttaaccttaaccgtttaaaccgtaacg

SEQ ID NO: 392827 - DNA, 738 bp, Homo sapiens
  misc_feature: GZ8MTXP01AUPAC.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaagtgtccagtgtgaggtgcgaggtggtggagtcgtgggggaagcttggtacagccgtgggacggtcctgagactcttctgtgcagcctgtggtattcgtaactttagtagttatagtaaagtgaacgtgggtcccgcgacggccgtaccggaggggaacggggtcgtagggtaggttgggtttacattactatttacgtaagtaattcgtacggtacccatacatatcgaatacgttctcgtaggtagggaaacggggtccgtaactttccgaaccctacttcccgacccgtaaaggaaccgaaacccgaaaccggtaccccgaaagggtaaacccttacccgtttaactttaacctacgttaacgaaccgtaaaaggttcggaacgtaccgaacggtacccgttaggaacggtaacggttacgggaaaccgggttaaccggtttaacggggtttaaactttttagtaacggttgggttacggtacggttaaggtaacgtaagtttacggttcgttaggttaacgttacgttcgggtccggtttaccggggattaaccgttaaagttcgg

SEQ ID NO: 392828 - DNA, 584 bp, Homo sapiens
  misc_feature: GZ8MTXP01AZDU1.11.19.B08.1.454.CMB.2.raw
  modified_base (212)..(212): a, c, t, g, unknown or other
  modified_base (298)..(298): a, c, t, g, unknown or other
  modified_base (382)..(382): a, c, t, g, unknown or other
  modified_base (478)..(478): a, c, t, g, unknown or other
  modified_base (522)..(522): a, c, t, g, unknown or other
tcagcgagagataccacgaccggtgctcgatttagtgagtcagtaagggcgtcgagagaggtgccttagccctggattccaaggcatttccacttggtgatcagcactgaacacagaggactcaccatggagttgggctgtgctgggttttccttgttgctattttagaaggtgtccagtgtgaggtgcaggtggtggagtcgtgggggaancgttggtacagcctggagggtccctgagactctctgtgcagcctctggattcgactttagagttatggaaattgaacgtgggtccnccaggctccgaagggaagggctaggaagtgggtttcattacgagtttcctaggtaaacttcgtaggttacccccatacactacnggtacaggtctaccgtggtcgaaacggggcctattcaaccattcacgagcgaacaacgtccagggtacctcacctttaatccggtatccaaagggngacgcacgcctagagacgtcgaacggtcgtacgttattcgtaanggttgagagagtaacttacgttcttacgtctagtcgtacggtaccggataaccgttaacgtg

SEQ ID NO: 392829 - DNA, 628 bp, Homo sapiens
  misc_feature: GZ8MTXP02H55HG.11.19.B08.1.454.CMB.2.raw
  modified_base (489)..(489): a, c, t, g, unknown or other
  modified_base (494)..(494): a, c, t, g, unknown or other
  modified_base (505)..(505): a, c, t, g, unknown or other
  modified_base (559)..(559): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggaggtccctgagactcttctgtgcagcctctggattcgactttagtagttatgaaatgaactgggtccgccgaggcccctacgggaaggggacggtcggtaggtgggtttcggtatactactttacttagttaaagtttactcgtacgtacctaactacctatagtcgacgtcgttctcgttaggaacgggtaccgggtacttacgacctaactcctaccacgaagaacaaaccgacccgaacgaaacgtcctaacttacttnacganaaactagaganacgacgtcgaagaggacgtacgggaagtaccggttaaagtttattactttaggnggtacggacgaagaggttatcgttgtacgtgttacgtccggtaccgggtacggacttaacgttagtacg

SEQ ID NO: 392830 - DNA, 507 bp, Homo sapiens
  misc_feature: GZ8MTXP02JVN3S.11.19.B08.1.454.CMB.2.raw
  modified_base (297)..(297): a, c, t, g, unknown or other
  modified_base (372)..(372): a, c, t, g, unknown or other
  modified_base (391)..(391): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccnccaggctccgagggagggctggagtgggttcatactatttctagtaatctggtaccccatacactatgcagtctntgtgaggccattcacatcncagagacacgcagaactcacttatctgacaaatgagcagcctgagagtcgaggactagggtatttatacgtgtgcgagagatacgtctagtctatcgcgttcgggatctaacgtag

SEQ ID NO: 392831 - DNA, 527 bp, Homo sapiens
  misc_feature: GZ8MTXP02HUZB6.11.19.B08.1.454.CMB.2.raw
  modified_base (346)..(346): a, c, t, g, unknown or other
  modified_base (424)..(424): a, c, t, g, unknown or other
  modified_base (524)..(524): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtactgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccgaggggagggctggagtggtttcatacatttctagtaattcngtaccatacactatgcagtctctgtagagggccgattcacatcctccagacgacaacgcccaggaacctctactttanctagactaaatgagcagcctagaagacgtacgaggacacgggttatttaatacgtgtgcgagagatacgtctgtctaagtcgcttcgggatcctaaactntcg

SEQ ID NO: 392832 - DNA, 515 bp, Homo sapiens
  misc_feature: GZ8MTXP02H9IYP.11.19.B08.1.454.CMB.2.raw
  modified_base (295)..(295): a, c, t, g, unknown or other
  modified_base (397)..(397): a, c, t, g, unknown or other
  modified_base (425)..(425): a, c, t, g, unknown or other
  modified_base (491)..(491): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccnccaggctccgagggaaggggctggagtgggtttcatacatttctagtaattctggtaccccatacactatgcagtctctgtggaagggccgattcaccatcnccagagacaacgccaggaactcacttanctagcaaatgagcagcctagagagtcgaaggacacgggtatttattacgtgtgcgagagatagtcngtctatgcttccgggatctaacta

SEQ ID NO: 392833 - DNA, 532 bp, Homo sapiens
  misc_feature: GZ8MTXP02JVYZ0.11.19.B08.1.454.CMB.2.raw
  modified_base (432)..(432): a, c, t, g, unknown or other
  modified_base (488)..(488): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttgggtacagcctgggagggtccctgagactcttctgtgcagcctctggattcgactttagtagttatgaaatgaactgggtccgccaggctccgaggggaaggggctgggagttggggtttcatactatttctagttaatctggtaccccatacactatgcagtctctgtgaagggccattcaccatctccagagacaacgccaggaactcactttanctagactaaatggaagcaagcctagagagtcgaggactacgggtatttatacgtgngcgagagatagtctgtctagtcgccgttaccgggatctaactag

SEQ ID NO: 392834 - DNA, 509 bp, Homo sapiens
  misc_feature: GZ8MTXP02GDIWY.11.19.B08.1.454.CMB.2.raw
  modified_base (296)..(296): a, c, t, g, unknown or other
  modified_base (419)..(419): a, c, t, g, unknown or other
  modified_base (434)..(434): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccncaggctccgagggagggctggagtgggttcatacatttcagtaatctgtaccccatacactatgcagtctctgtgaagggccattcaccatctccagacgacaacgccaggaactcactttanctagacaaaatgaancagcctagagagtcgagactacgggtattatactgtgcgagagactagtctgtctatgcttcgggatctaactag

SEQ ID NO: 392835 - DNA, 523 bp, Homo sapiens
  misc_feature: GZ8MTXP02G4YC9.11.19.B08.1.454.CMB.2.raw
  modified_base (402)..(402): a, c, t, g, unknown or other
  modified_base (422)..(422): a, c, t, g, unknown or other
  modified_base (445)..(445): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccgaggggaaggggctggagtgggtttcatacatttctagtaatctggtaccccatacactatgacagtctctgtgaagggccattcaccatcctcaganacaacgcagaactcacttanctagcaaatgagcagcctagagngtcgaggactacggggtatttactacgtgtagcgagagtattacgtctagtctatcgtcgttccgggatactaactag

SEQ ID NO: 392836 - DNA, 514 bp, Homo sapiens
  misc_feature: GZ8MTXP02I48TE.11.19.B08.1.454.CMB.2.raw
  modified_base (422)..(422): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccgagggaaggggctggagtgggtttcagtacatttctagtattctggtaccccatacactatgcagtctctgtgaagggcctattcaccatctccagagacaacgcaggaactcacttanctgacaaatgagcagcctgagagtcgaggacacgggtatttactactgtgcgagagtatagtctgtctatcgtcgtcgggacacgtaactag

SEQ ID NO: 392837 - DNA, 514 bp, Homo sapiens
  misc_feature: GZ8MTXP02FLHDQ.11.19.B08.1.454.CMB.2.raw
  modified_base (505)..(505): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccgagggaggggctggagtgggttcatacatttctagtaattctggtaccccatacactatgcagtctctgtgaagggccattcaccatctccagacgacaacgccaggaactctacttatctgacaaatgagcagcctagacgagtcgaggacgacgggtattatactgtgcgtagagatagtctgtctatcgcttcggganacgtactag

SEQ ID NO: 392838 - DNA, 530 bp, Homo sapiens
  misc_feature: GZ8MTXP02JVIL2.11.19.B08.1.454.CMB.2.raw
  modified_base (281)..(281): a, c, t, g, unknown or other
  modified_base (298)..(298): a, c, t, g, unknown or other
  modified_base (431)..(431): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctcgtggattcgactttagtagttangaaatgaactgggtccnccaggctccgagggagggctggagtgggttcatacatttctaagttaattctaggtaccccatacactatgcagtctctggtgaagggccattccaaccatcctccagagacaacgcaggaactctactttanctgacaaatgagcagcctgagagtcggagacgtacgggtattagttacgtgtgacgagagtataggtctgtctagtcgcgttaccgggatactaactag

SEQ ID NO: 392839 - DNA, 526 bp, Homo sapiens
  misc_feature: GZ8MTXP02G1U6P.11.19.B08.1.454.CMB.2.raw
  modified_base (297)..(297): a, c, t, g, unknown or other
  modified_base (425)..(425): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccnccaggctccgaggggaggggctggagtgggttcatactatttctagtaattctggtacccatacactatgcagtctctgtgaacgggcattcaccatctaccagacgacaacgcaggaactcacttanctagacaaatgagcagcctagagagtcgaggactacgggtattagttactgtgacgagagtatacgtctgtctagtcgtcgttacgggactactaacgtag

SEQ ID NO: 392840 - DNA, 542 bp, Homo sapiens
  misc_feature: GZ8MTXP02GURDO.11.19.B08.1.454.CMB.2.raw
  modified_base (212)..(212): a, c, t, g, unknown or other
  modified_base (296)..(296): a, c, t, g, unknown or other
  modified_base (369)..(369): a, c, t, g, unknown or other
  modified_base (396)..(396): a, c, t, g, unknown or other
  modified_base (416)..(416): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagcctggagggtccctgagactcttctgtgcagcctctggattcgactttagtagttatgaaatgaactgggtccnccaggctccgagggagggctggagtgggttcatacatttcagtaatctggtaccccatacactatgcagtctntgtagaaggccattcaccatctcaganacaacgcagaactcacttanctagacaaatgagtacacgcctagtaggagtacggaacgggtacgtacggggttatttaacgttacgtggtgacgtagacgtatacgtctgtcttagtcgtccgttaccggggatacgttaactag

SEQ ID NO: 392841 - DNA, 529 bp, Homo sapiens
  misc_feature: GZ8MTXP02JXILN.11.19.B08.1.454.CMB.2.raw
  modified_base (421)..(421): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccgccaggctccgagggaggggctggagtgggttcatactatttctagtaattctggtacccatacactatgcagtctctgtgagggccgattcaccatcctcagagacaacgcaggaactcacttanctagacaaatgagcagcctagacggtagtcggaggacgtacgggttatttacgtacgtgtcgcgaagagtatacgtctgtctagtcgtcgttcgggactctaacgtgg

SEQ ID NO: 392842 - DNA, 511 bp, Homo sapiens
  misc_feature: GZ8MTXP02H5DKR.11.19.B08.1.454.CMB.2.raw
  modified_base (208)..(208): a, c, t, g, unknown or other
  modified_base (253)..(253): a, c, t, g, unknown or other
  modified_base (291)..(291): a, c, t, g, unknown or other
  modified_base (388)..(388): a, c, t, g, unknown or other
  modified_base (415)..(415): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (435)..(435): a, c, t, g, unknown or other
  modified_base (477)..(477): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcttgttgctattttagaagtgtcagtgtgaggtgcaggtggtggagtcgtgggggaancttggtacagcctggagggtccctgagctcttctgtgcagccctntggattcgactttagtagttatgaaatgaactggtccncaggctccgagggaagggctggagtgggtttcatacatttctagtaatctggtacccatacactatgacagtctctgtgaagggccattcaccatcncagacacaacgtcaagactcactttantananaanagagacacgacngagagagagagagtattattactgtgacgagagtagtacgtntgtcgtagtacgtcgtacggtacgtactaactag

SEQ ID NO: 392843 - DNA, 535 bp, Homo sapiens
  misc_feature: GZ8MTXP02JUL2K.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgccaggcctaccgaggggaggggctggagtgggttcatactatttctagtaattctggtaccccatacactatgcagtctctgtgaagggccattcacatctccagacgacaacgacaggaactctacttatctagacaaatgagcacgcctagagagtacggaggacgtacgggtatttacgttactggtgcggagagtatacgtctgtctagtcgtacgttccgggatactaactag

SEQ ID NO: 392844 - DNA, 529 bp, Homo sapiens
  misc_feature: GZ8MTXP02HM9IF.11.19.B08.1.454.CMB.2.raw
  modified_base (296)..(296): a, c, t, g, unknown or other
  modified_base (367)..(367): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtcnccaggctcgagggagggctggagtgggttcatacatttcagtatctggtaccccatacactatgcagtctntgtgaaggtcattcaccatctcagagacaacgcaggaactctactttatctagacaaatgagcagcctgagagtcggaaggactaacggggtatttaagttactggtggacgagagtatacgtctagtctagtcgtcgttaccgggataccgttaaactacg

SEQ ID NO: 392845 - DNA, 534 bp, Homo sapiens
  misc_feature: GZ8MTXP02FOBYD.11.19.B08.1.454.CMB.2.raw
  modified_base (296)..(296): a, c, t, g, unknown or other
  modified_base (399)..(399): a, c, t, g, unknown or other
  modified_base (423)..(423): a, c, t, g, unknown or other
  modified_base (498)..(498): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactggtccncaggctcgagggaggctggagtgggttcatacatttctagtattctgtacccatacactatgcagtctctggtgaacggggcctattccaactatctccaganacaacgacagaactctactttacnctagactaaagtgagcacgactagagagtacggacggacgtaggttattatacgtgagacgagacgtagtacgtnttagtctacgtcgtaccgtacggactacgtaatacg

SEQ ID NO: 392846 - DNA, 521 bp, Homo sapiens
  misc_feature: GZ8MTXP02GWBX0.11.19.B08.1.454.CMB.2.raw
  modified_base (297)..(297): a, c, t, g, unknown or other
  modified_base (419)..(419): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccncaggctccgagggaggggctggagtgggttcatacatttctagtatctggtacccatacactatgcagtctctgtgaagggccattccaccatctccagagacaacgccaggactcacttanctgacaaatgagcagcctgagagtcgaggacgtacggtatttatactgtgcgtagagacgtagtctaggtcttagtcgtacgttccgggagtacctaactag

SEQ ID NO: 392847 - DNA, 521 bp, Homo sapiens
  misc_feature: GZ8MTXP02FVFOA.11.19.B08.1.454.CMB.2.raw
  modified_base (393)..(393): a, c, t, g, unknown or other
  modified_base (413)..(413): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgcaggctccgagggagggctggagtgggttcatacatttctagtattctgtacccatacactatgcagtctctgtgaaggcctatcacatctcaganacaacgcagactctacttanctagacaaatgagcagcctagagagtcggaaggacgtacgggttatttacttacgtgtagacgagagtatagtctgtcgtagtcgtccgtaccgggatacgtaactag

SEQ ID NO: 392848 - DNA, 532 bp, Homo sapiens
  misc_feature: GZ8MTXP02IPHFX.11.19.B08.1.454.CMB.2.raw
  modified_base (436)..(436): a, c, t, g, unknown or other
  modified_base (456)..(456): a, c, t, g, unknown or other
  modified_base (489)..(489): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgccaggctccgagggaggggctggagtgggttcatactatttctagtaattctggtacccatacactatgctagtctctgtaggaacgggcccgtattccaccatctacccagacgacaacgaccaggaactcaactttanctgacaaatgagcagcctgngagtcgaggactacgggtatttattactgtcgngagagatagtctgtctagtcggtcttacgggacgtctaactag

SEQ ID NO: 392849 - DNA, 519 bp, Homo sapiens
  misc_feature: GZ8MTXP02GSPX4.11.19.B08.1.454.CMB.2.raw
  modified_base (391)..(391): a, c, t, g, unknown or other
  modified_base (418)..(418): a, c, t, g, unknown or other
  modified_base (431)..(431): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcgttggtacagccgtgggagggtccctgagactcttctgtgcagcctctggattcgactttagtagttatgaaatgaactgggtccgcaggctccgagggagggctggagtgggttcatactatttctagtaattcgtaggtacccatacactatgctagtctctgtgaggccatcacntctcagagacacgcagactctacttanctagacaaatganctagcctgagagtcgaggaccgtagggttattatacgtgtgcgagatatagtctagtctagtcgtcgttaccgggataccgtaatacg

SEQ ID NO: 392850 - DNA, 525 bp, Homo sapiens
  misc_feature: GZ8MTXP02JP6BZ.11.19.B08.1.454.CMB.2.raw
  modified_base (295)..(295): a, c, t, g, unknown or other
  modified_base (393)..(393): a, c, t, g, unknown or other
  modified_base (422)..(422): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccnccaggctccgagggagggctggagtgggtttcagtactatttctagtaattctggtaccccatacactatgcagtctctgtgaagggcattcacatcnccagagacaacgccaggaactcactttanctagacaaaatgaagcagcctagagagtcgaaggacgtacgggttattattactgtgacgtagagatagtctagtctagtcgtcgtccgggatacctaactag

SEQ ID NO: 392851 - DNA, 600 bp, Homo sapiens
  misc_feature: GZ8MTXP02H2AAF.11.19.B08.1.454.CMB.2.raw
  modified_base (296)..(296): a, c, t, g, unknown or other
  modified_base (450)..(450): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccnccgaggctccgaggggaaggggctggagttgggtttcagttacattttcaagttaattctaggtaccccatacactatgcagtctcgtgtacgaagggcctatccaaccatcctaccgaagacgaacaaaccgccaaggaactacctactttanctgaacaaagtcgagacagtcctaggaagaggtccggaagggtaaccgtacggggtttaatttaacgtttacgtggttaggacgagacggtaacttcgttacgtgttaaccgtagtcgttaccgttacggggtactaccgttaaactacg

SEQ ID NO: 392852 - DNA, 551 bp, Homo sapiens
  misc_feature: GZ8MTXP02JTEWZ.11.19.B08.1.454.CMB.2.raw
  modified_base (449)..(449): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgccaggctccgaggggaggggctgggagtggggtttcagtactatttctaagtaattcgtaggtaccccatacactatgcagtctctgtgaagggccattccaccatctccagacgacaacgaccaggaactacacttatctagacaaatgancgagcctgagagtcggaggacgtaagggttatttaagttacgtgtcgacggagaagtagtagtctggtctagtcgtacgttaccgggactacgtaacttacg

SEQ ID NO: 392853 - DNA, 631 bp, Homo sapiens
  misc_feature: GZ8MTXP02JIFDI.11.19.B08.1.454.CMB.2.raw
  modified_base (210)..(210): a, c, t, g, unknown or other
  modified_base (511)..(511): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcctgttgctattttagaaggtgtccagtgtgaggtgcaggtggtggagtcgtgggggaancgttggtacagccgtgggacgggtccctgagactcttctgtgcagcctcgtggattcgtactttagtagttatagaaatgaacgtcgggtccgaccgagggcctaccggaagggggaacggggcgtagggaggtttcgggtttaccaagtacttattttaccgtaaagtttaacttccgttaggtaacccctaattaaccacgtaagtcgactagttctcgttggtacgggaaacgggcccgtaatttaccgacctactctacccgaagacgacaaaccgcaacggaactctaacgtttanacttagaacaaaagtcgaacgactacgcctaggaagaggtacgaaggtaaccgtaaggttatttacgtacgtgtgacgagatatacgtctgtgtacgcgtcgttacggatactaacgtag

SEQ ID NO: 392854 - DNA, 523 bp, Homo sapiens
  misc_feature: GZ8MTXP02F6ET6.11.19.B08.1.454.CMB.2.raw
  modified_base (424)..(424): a, c, t, g, unknown or other
  modified_base (437)..(437): a, c, t, g, unknown or other
  modified_base (514)..(514): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgcaggctccgagggagggctggagtgggttcatacatttcagtattctgtaccccatacactatgcagtctctgtaggaacgggcctattccacctatcctaccagacgacaacgcaggaactcacttanctagacaaatgancagcctagagagtcgagacacgggttatttatactgtagcgagagtatacgtctagtctagtcgtacgttccggganactaactag

SEQ ID NO: 392855 - DNA, 701 bp, Homo sapiens
  misc_feature: GZ8MTXP02JBRRK.11.19.B08.1.454.CMB.2.raw
  modified_base (479)..(479): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttggtacagcctgggagggtccctgacgtacttcttctgtgcacgtcctcgtggtacttcgtacttagtagttatagtaatgacgtcggtccgcgagctacggagggaggcgtggtaggttggttacagtacttatttactaagttacttcgtacgtaccctatacactatgactacgtctcgtggtacggacggtccgtacttaccgactactcctaaccgaagacaaaccgaaccgaccgaacggtaaccttcgttaactttacncgttacgaaactaaagtcggacgacgtaccggtaccgtagggaacggtacgggtaacgggtaaacgggtacccgttaaaggggtttttaaactttaaccgttacggtagggttacgaacggggttaaaggtacgttacgtttaacggttccgtttaggttaacgttacggttccgggttaccccgggttaagggaaccttaaccgtttaaaacgttaaccgg

SEQ ID NO: 392856 - DNA, 566 bp, Homo sapiens
  misc_feature: GZ8MTXP02HVFJP.11.19.B08.1.454.CMB.2.raw
  modified_base (209)..(209): a, c, t, g, unknown or other
  modified_base (296)..(296): a, c, t, g, unknown or other
  modified_base (373)..(373): a, c, t, g, unknown or other
  modified_base (399)..(399): a, c, t, g, unknown or other
  modified_base (405)..(405): a, c, t, g, unknown or other
  modified_base (429)..(429): a, c, t, g, unknown or other
  modified_base (433)..(433): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcctgttgctatttagaaggtgtccagtgtgaggtgcaggtggtggagtcgtgggggaancttggtacagccgtgggagggtccctgagactcttctgtgcagcctcgtggattcgactttagtagttatgaaatgaactgggtccnccgaggcctccgaggggaagggctggagtgggttcatactatttcagtattctgtaccccatacactatgcagtctntgtagaacgggtcctattcaccatcnccaganaacaaccgcaagactctactttanctancaaatcgatcagcctagagacgtacggaaggactacgggttattttaagttacgtaggttggacgtaaggtacgtaagttacgttcgtcgttaacgttagcgttccggttaccggggataccttaaaacgtag

SEQ ID NO: 392857 - DNA, 550 bp, Homo sapiens
  misc_feature: GZ8MTXP02I6SRQ.11.19.B08.1.454.CMB.2.raw
  modified_base (434)..(434): a, c, t, g, unknown or other
tcagcgagagataccacgaccggtgctcgatttagtgagtcagtaaggggctcagagaggtgccttagccccggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccgccaggctccgaggggaagggctggagtgggtttcatactatttctagtattctggtaccatacactatgcagttctcgtgtggaacgggccattcaccatcctacccagaagacaacgccaaggacctctaactttanctgacaaatgaagcagcctagagagtcggaggactacggggttatttagttacgtgtggacgaggagtattacgtctgttctaagtcgtacgttccggggatacgtaactgttacg

SEQ ID NO: 392858 - DNA, 563 bp, Homo sapiens
  misc_feature: GZ8MTXP02JIAXX.11.19.B08.1.454.CMB.2.raw
  modified_base (212)..(212): a, c, t, g, unknown or other
  modified_base (297)..(297): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagcctgggagggtccctgagactcttctgtgcagcctctggattcgactttagtagttatgaaatgaactgggtccncaggctccgagggagggctggagtggttcatacatttctagtattctggtaccactatactactagtcgctctctgtgaggacggtactactaccactctccacgaacgacgaacgaccgacgaacgtacctacttaacttctcgtacgaaactagagacacgaccgtcgtaggagtacggacggacgtacggttaagttatttacgtagtgacgagtaagagtagtcgtgtcgtacttagtcgtccggtacggtactacttaacg

SEQ ID NO: 392859 - DNA, 616 bp, Homo sapiens
  misc_feature: GZ8MTXP02FXMJD.11.19.B08.1.454.CMB.2.raw
  modified_base (482)..(482): a, c, t, g, unknown or other
  modified_base (496)..(496): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggacgggtccctggagacttcttctgtgcacgcctctggtattcgtactttagtagttatagtaaatgaacgtcgggtcccgcgaggccgtaccggaaggggaacggggcgtgggtaggttcggggtttacaagttactattttacgtaagtaatttcgtagtaacccctatactactatgcctagtctacgtggtaggacgggcctatccacctatccctccaagacgaacacgaccgaagtaactctacttanctagacaaagtgancaagtcctagaggagtacgggaagaccggtaagggtttatttacgttacgtggtagacggtaagtacgtattacgtcgttataacgttagtcgtaccggttaccggagacctttaacgag

SEQ ID NO: 392860 - DNA, 578 bp, Homo sapiens
  misc_feature: GZ8MTXP02IK4PA.11.19.B08.1.454.CMB.2.raw
  modified_base (298)..(298): a, c, t, g, unknown or other
  modified_base (393)..(393): a, c, t, g, unknown or other
  modified_base (429)..(429): a, c, t, g, unknown or other
  modified_base (440)..(440): a, c, t, g, unknown or other
  modified_base (443)..(443): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacaggcctgggagggtccctgagactcttctgtgcagcctctggattcgactttagtagttatgaaatgaactgggtccncaggctccgagggagggctggagtgggtttcatactatttcagtatcgtggtaaccccatacactatgcagtctctgtagaaggcctattcaccntctccaagacgaacaccgcaggaaactcaactttanctagataaagnganacacgcgtagagacggtacgaaggtacgtaacgggtttattaacgttacgtggtacggacggtagtaagtacgttacgttcttacgttaacgttacgtcggttaccggttaccgggacttaacctttaaacgtag

SEQ ID NO: 392861 - DNA, 652 bp, Homo sapiens
  misc_feature: GZ8MTXP02HJA4A.11.19.B08.1.454.CMB.2.raw
  modified_base (302)..(302): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgctattttagaaggtgtccagtgtgaggtgcaggtggtggagtcgtgggggaagcttggtacagccgtgggacgggtccctgagtactcttctgtgcagcctctggtattcgactttagtagttatagaaatgaacgtggtccncgaggcctcggagggagggtctggaggttgggttacagttactatttctaagttaattcgtaggtaacccctatactactatgcagttctcgtgtacggaacggccgtattccaacctatcctaccgaagacgaaacaacccgaccgaacggtaacctacttaactttacacttacgtaacaaattgaacgtcacgtacctaggaacgtacggtacggaaacgggtacttaacggggtttattttaaacgttacgttacggttaggtacgtaagtaacggttacgtaacgttcgtaggtttaactaggttcggtaccggttaccggtacgtaccgtttaaaacgttacgg

SEQ ID NO: 392862 - DNA, 693 bp, Homo sapiens
  misc_feature: GZ8MTXP02JRUJX.11.19.B08.1.454.CMB.2.raw
  modified_base (212)..(212): a, c, t, g, unknown or other
  modified_base (402)..(402): a, c, t, g, unknown or other
  modified_base (514)..(514): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagcccgtgggacggtcctgagtacttcttcgtgtcgcacgtcctcgtggtattcgtaactttagtagttatagaaatcgaacgtcgggtccaccgaggcctaccggaaggggaggggcgtaggtaggttcgggtttacagttactatttactaagttacttcgtacgtacccatactactangtcagttctcgtggtacggaacggggcctaatttccaactactcctaccgaagacgaacgtaaacccgccgaaacggtaacttacctaactttactcctagaacgttaaaancggtacgaccgacgtacccgagtaacggtacggtaccggaaggggtaaaccgttacggggtttaaattttacgttacgttaggtacggaacgggtaaagaaggttacgttacgttccgttggttaacctttaagtaccggtccgggttaaccgggtactaacccgtttaagtttaacgg

SEQ ID NO: 392863 - DNA, 513 bp, Homo sapiens
  misc_feature: GZ8MTXP02G0RL9.11.19.B08.1.454.CMB.2.raw
  modified_base (293)..(293): a, c, t, g, unknown or other
  modified_base (429)..(430): a, c, t, g, unknown or other
  modified_base (481)..(481): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtctgggggaagcttggtacagcctggagggtccctgagactcttctgtgcagcctctggattcgactttagagttatgaaatgaactgggtccncaggctccgagggaagggctggagtgggtttcatacatttctagtaattctggtaccccatacactatgcagtctctgtgaagggccattcaccatctccagagacaacgcagaactcacttatctgacaaatgannagcctagagagtcgaggacacgggtatttatactgtagcgagagatacgtntgtctactagtcgtcggtacggactactaacg

SEQ ID NO: 392864 - DNA, 525 bp, Homo sapiens
  misc_feature: GZ8MTXP02FTCAE.11.19.B08.1.454.CMB.2.raw
  modified_base (278)..(278): a, c, t, g, unknown or other
  modified_base (296)..(296): a, c, t, g, unknown or other
  modified_base (370)..(370): a, c, t, g, unknown or other
  modified_base (417)..(417): a, c, t, g, unknown or other
  modified_base (429)..(429): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttangaaatgaacgtgggtccnccaggctcgagggagggctggagtgggttcatacatttctagtaattctggtaccccatacactatgcagtctntgtgaggcctattcacatctccagacacaacgcaaggactctacttnctgacaaatgancagcctagagagtcgaggaccaggttatttagtactggtgacggtagagtagttacgtctagtctaagtcgtaccgtccgggataccgttaactag

SEQ ID NO: 392865 - DNA, 566 bp, Homo sapiens
  misc_feature: GZ8MTXP02G8S44.11.19.B08.1.454.CMB.2.raw
  modified_base (297)..(297): a, c, t, g, unknown or other
  modified_base (436)..(436): a, c, t, g, unknown or other
  modified_base (450)..(450): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatagaaatgaactggtccncaggctcgagggaggctggagtggttcatacatttcagtattctgaccccatacactatgacatctctggtggaacgggtccgaattccgaacctatcctacccaagacgaacaaccgcaacggaactacgtaacttanctagaccaaatgancacgccgtagagacggtacgaaggtacgtacgggttaatttacgttacgtggtacgaggtaagagtacgtaggtcttagtcgtaactcgtccgttacgggactacttaaacgtacg

SEQ ID NO: 392866 - DNA, 535 bp, Homo sapiens
  misc_feature: GZ8MTXP02I5GE4.11.19.B08.1.454.CMB.2.raw
  modified_base (293)..(293): a, c, t, g, unknown or other
  modified_base (393)..(393): a, c, t, g, unknown or other
  modified_base (416)..(416): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcctgttgctattttagaaggtgtccagtgtgaggtgcaggtggtggagtctgggggaagcttggtacagcctggagggtccctgagactcttctgtgcagcctctggattcgactttagtagttatgaaatgaactgggtccnccaggctcgagggagggctggagtgggttcatacatttctagtatctggtaccccatacactatgcagtctctgtgaagggccattcaccatctccaganacaacgccaggaactcactttanctgactaaatgacgcagcctagagaggtcgaagggactacggggttaatttacgtacgtggttaggacgtaggagtactagtcttgtctagtcgtcgttccggggatacgtaacttacg

SEQ ID NO: 392867 - DNA, 531 bp, Homo sapiens
  misc_feature: GZ8MTXP02JPL7I.11.19.B08.1.454.CMB.2.raw
  modified_base (429)..(429): a, c, t, g, unknown or other
  modified_base (442)..(442): a, c, t, g, unknown or other
  modified_base (481)..(481): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttattgctattttagaaggtgtccagtgtgaggtgcaggtggtggagtcgtgggggaagcttggtacagcctggagggtccctgagactcttctgtgcagcctctggattcgactttagtagttatagaaatgaacgtgggtccgccgaggctccgaggggaggggctgggagtgggtttcaattactatttctaagtaattctggtaccccatacactatgcagtctctggtgaagggccattcacatctcagagacaacgcagaactcacttanctagacaaatgancagctagagagtggaaggacgtaggttattaagttacgngtgcgaagagtatacgttctgtctagtgtcgttacgggatactaacttag

SEQ ID NO: 392868 - DNA, 659 bp, Homo sapiens
  misc_feature: GZ8MTXP02GVCL7.11.19.B08.1.454.CMB.2.raw
  modified_base (296)..(296): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccncaggctccgagggaggggctggagtggttcatacatttctagtatctggtaccccatacactatgcagtctctggtggaaacggggccgtaatttccaaccctatcctacccgaagacgaaccaaaccgaccaacgggaaaccttacctaacttttaactccttacgacctaaaatcggaagaccaaggcccctagggaacgtaggtaccggaaaggggtaacctaacgggggtttaattttaacgttaacgttggttacggaacggtaaggaaacggtaacgttaacgggttccttaggttaaccgttaacgttcgggtaccggtttacccgggggaacgttaccgtttaaaactttaacgg

SEQ ID NO: 392869 - DNA, 567 bp, Homo sapiens
  misc_feature: GZ8MTXP02GZ2YT.11.19.B08.1.454.CMB.2.raw
  modified_base (303)..(303): a, c, t, g, unknown or other
  modified_base (437)..(437): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtcagtgtgaggtgcaggtggtggagtcgtgggggaagcttggtacagccgtgggagggtccctgagtactcttctgtgcagtcctctggtattcgtactttagtagttatagaaatgaacgtgggtccnccgaggcctccgaggggaagggcgtggagtcgggtccatactattctagtatcgtgtacccatacactatgcagtctctgtagaacgggcattcaccatctaccgagacacaacgcaacggactctactttacnctagactaaaatgagacagcctagagaggtacgaacggaccgtaaaggggtttatttaacgttacgttggtagacggtaagaagtacttagtctggtaactagtcgtaccgtacgggactactaacgtag

SEQ ID NO: 392870 - DNA, 572 bp, Homo sapiens
  misc_feature: GZ8MTXP02HM73E.11.19.B08.1.454.CMB.2.raw
  modified_base (299)..(299): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttggtacagcctgggagggtccctgagactcttctgtgcagcctctggattcgactttagtagttatagtaaatgaacgtgggtccnccgaggctccgaggggagggctggagtgggttcagttacattttctaagtaattcgtaggtaccccatacactatgcagtctcgtgtagacggggtcctagttccaccatcctacccagacgaccaaccgccgaacggactactactttatctagactaaatgtagacaggccctagagtagtacgaacggacgtacggggttatttagttacgtgttggacgaagtagtactagtctggtctagtcgtacgtacggacgtacttaacgtacg

SEQ ID NO: 392871 - DNA, 551 bp, Homo sapiens
  misc_feature: GZ8MTXP02HF2S3.11.19.B08.1.454.CMB.2.raw
  modified_base (212)..(212): a, c, t, g, unknown or other
  modified_base (302)..(302): a, c, t, g, unknown or other
  modified_base (434)..(434): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancgttggtacaggccctgggagggtccctgagtactcttctgtgcagcctcgtggattcgactttagtagttatgaaatgaactgggtccnccagctcgagggaggctggagtggttcagtactatttcagtatcgtggtacccatacatatgcagtctctgtaggaacgggtccgattccacctatcctaccagacgacacgaccaggtaactctactttanctagactaaagtgaagcagcctagagagtcgaggtacacgggttattacgttacgtgttgacgaagacgtagtacgtcgtagtctagtcgtaccggttaccggagtacttaactaag

SEQ ID NO: 392872 - DNA, 653 bp, Homo sapiens
  misc_feature: GZ8MTXP02HHEN3.11.19.B08.1.454.CMB.2.raw
  modified_base (300)..(300): a, c, t, g, unknown or other
  modified_base (470)..(470): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcgaggtggtggagtcgtgggggaagtcttggtacagccgtgggagggtccctgagactcttctgtgcagcctctggattcgactttagtagttatagaatgaactgggtccncaggctccgagggaggctggagtggttcatactattctagtattcgtggtacccatactactatgcagtctcgtaggtacggacggggccgtattccacccgtattccgtacccgaaggaacgtacccgaaaccggacctaaacgggtaaccttacgtaaaccttttacnccgttaggaaacctaaaagttcggaacgacgtaacggtaccgtaggaacggtacggtaccgggtaaacgggtaaccggttaacggggtttaattttaacgtacgttacggttggacggtaagacgtagttacgtccgttaggtaacctaggttcgtccggttacggacaacgtttaactacgg

SEQ ID NO: 392873 - DNA, 590 bp, Homo sapiens
  misc_feature: GZ8MTXP02I8L5H.11.19.B08.1.454.CMB.2.raw
  modified_base (451)..(451): a, c, t, g, unknown or other
  modified_base (578)..(578): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttggtacagcctggagggtccctgagactcttctgtgcagcctctggattcgactttagtagttatagaaatgaacgtgggtcccgcgaggcctccgaggggacggggctggagttgggttcattacatttctagtaattcgtaggtaccctatacactatgcagtctcgtggtagaacggggcctattccaccctaatcctaccagacgaccaacgaccagtaacctctaactttacncttagacctaaagtgtaacgacgacgccgtagaggacgtacggaacggtacgtacgggttatttagtacgtggtgacggaagtagtagttacgtcgttagtccgttatcggttacgtaccggggtanacttaacgtacg

SEQ ID NO: 392874 - DNA, 568 bp, Homo sapiens
  misc_feature: GZ8MTXP02F8RV1.11.19.B08.1.454.CMB.2.raw
  modified_base (295)..(295): a, c, t, g, unknown or other
  modified_base (450)..(450): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccncaggctccgagggaaggggctggagtgggttcagtacatttctagtaattctaggtaccccatacactatgcagtctctggtagaaacggggcctaatttccaacctatcctacccaagaacgaacaaaccgacccaaggaacctctaactttancttagaccaaaagttcgaagcaagccctaggagtagtcggaaggacgtaacgggttatttaagttactggtagacgaagtagatagtctgtctagtcgtcgttcgggatactaactag

SEQ ID NO: 392875 - DNA, 644 bp, Homo sapiens
  misc_feature: GZ8MTXP02G7R1N.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagactcttctgtgcagcctctggattcgactttagtagttatagaaatgaacgtgggtccgccaggctccgagggagggctggagttgggttcattactatttctaagttaacttcgtaggtacccatacacgtatgacagtcttcgtaggtcgaaggggcctagttccaccctagtcctaccgagacgaacaaaccgcaaggtaacctactactttatcctagacctaaaagtgacgtacacggtaccgtagaacggacggtacggaacgggtaccgtacggggtttaaatttaacgttacgtcggttagacggtaaaggtaacgtaagttacggtactttaacggtcttaaacggttcggtacccggtttacccggggtaagtacccttaaaaaccgtttcgg

SEQ ID NO: 392876 - DNA, 553 bp, Homo sapiens
  misc_feature: GZ8MTXP02F1GNS.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgccaggctccgaggggaaggggctggagtgggtttcagtactatttctagtaattctggtaccccatacactatgctagtctctgtgaacggggccctatttccacctatcctacccgagacgaccaacgcccaaggaactctactttatctagacaaatgagcagcctagagagtcgaaggactacgggttatttagttactggtgacgagagtagtacgtctgtctagtcgtaccgttccgggagtactaactag

SEQ ID NO: 392877 - DNA, 601 bp, Homo sapiens
  misc_feature: GZ8MTXP02GQ4LP.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggtttccttgttgctatttagaaggtgtccagtgtgaggtgcaggtggtggagtcgtgggggaagcgttgggtacaggccgtgggagggtccctgagactcttctgtgcagtcctcgtggtattcgtactttagtagttatagaaatgaactgggtccgccgaggcctccgaggggaagggctgggaggtggttccatactatttctagtaatctagtacccatactactatgcagtctcgtggtaggaacgggcctaattccaccctatcctaccaagaacacgaaaccgcccaaggtaaccttctaacttatctagactaaaatcgaagccaacgcctaggagacggttacgaaggtaccgtaagggttattttaactacgtagtggacgtaagagtaacgttacgttctaggtaaccttagtcggtacccgtaccggggataccttaaaagtcg

SEQ ID NO: 392878 - DNA, 504 bp, Homo sapiens
  misc_feature: GZ8MTXP02FKCXM.11.19.B08.1.454.CMB.2.raw
  modified_base (295)..(295): a, c, t, g, unknown or other
  modified_base (394)..(394): a, c, t, g, unknown or other
  modified_base (416)..(416): a, c, t, g, unknown or other
  modified_base (428)..(428): a, c, t, g, unknown or other
  modified_base (496)..(496): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccnccaggctcgagggagggctggagtgggttcatacatttctagtaattctggtaccccatacactatgcagtctctgtgaaggccatcacatctccaganacaacgccagaactcactttanctgacaaatgancagcctgagagtcgaggacgagggttattatactgtgcgagagatacgctgtctagtcgcgtcggganactactag

SEQ ID NO: 392879 - DNA, 561 bp, Homo sapiens
  misc_feature: GZ8MTXP02JRPXZ.11.19.B08.1.454.CMB.2.raw
  modified_base (182)..(182): a, c, t, g, unknown or other
  modified_base (299)..(299): a, c, t, g, unknown or other
  modified_base (437)..(437): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgngaggtgcaggtggtggagtcgtgggggaagcttggtacagcctgggagggtccctgagactcttctgtgcagcctctggattcgactttagtagttatagaaatgaacgtgggtccnccaggctccgaggggaaggggctggagtggggttcatactatttctagttaattctggtaccccatacactatgcatctctggtgaagggccattcaccatcctccagacgaccaacgcaacggaactctactttacncttagacaaatgagtcagcctagagacgtaggagtacgtacgggttatttacgttacgtcggtagacggagagagttacgttcttagtcgtagtcggtaccgttacgggacgtactaacttacg

SEQ ID NO: 392880 - DNA, 564 bp, Homo sapiens
  misc_feature: GZ8MTXP02GK9BA.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatagaaatgaacgtgggtccgccaggctccgaggggaggggctggagttggttcatactatttctagtaatctggtaccccatacactatgctagtctctggtaggaacgggtcctatttccaccactctaccagacgacaacgaccacggaactactaacttactctagcaaaaaaatgagacacgcctagagaggtacggaaggaacgtacggttatttaacgttacgtgttagacgagagagtacgtcgtgtcgtagtcgtcgttacggacgtactaactaag

SEQ ID NO: 392881 - DNA, 536 bp, Homo sapiens
  misc_feature: GZ8MTXP02FNWYV.11.19.B08.1.454.CMB.2.raw
  modified_base (297)..(297): a, c, t, g, unknown or other
  modified_base (432)..(432): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccncaggctccgagggagggctggaggtgggttcatactatttcagtattcgtggtacccatacactatgcagtctctggtaggaacgggcctattcaccagtcctaccgagacgacaacgcacgtactctactttanctagacaaatgagcagctagagacgtgacgacgagggttattagtacgtgtgacgagagagttagtcgtgtaactgtcgtaccgttccggaatactaacgttag

SEQ ID NO: 392882 - DNA, 555 bp, Homo sapiens
  misc_feature: GZ8MTXP02G1RFG.11.19.B08.1.454.CMB.2.raw
  modified_base (298)..(298): a, c, t, g, unknown or other
  modified_base (439)..(439): a, c, t, g, unknown or other
  modified_base (496)..(496): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggaggtccctgagactcttctgtgcagcctctggattcgactttagtagttatagaaatgaacgtgggtccncaggctcgagggaggctggagtggttcatactatttactagtatcgtaggtaccccatacactatgcagtctctgtaggaacggccgtattccacctatcctacccaagacgaaccaaccgccaaggaactctaactttanctagactaaagtgagcagcctagagagtacggaggacctagggttatttagttacgnggtagcgaagagtacgtagtcgtagtcgtagtcggtaccgttacgggactactaacgtg

SEQ ID NO: 392883 - DNA, 650 bp, Homo sapiens
  misc_feature: GZ8MTXP02JXTYU.11.19.B08.1.454.CMB.2.raw
  modified_base (210)..(210): a, c, t, g, unknown or other
  modified_base (279)..(279): a, c, t, g, unknown or other
  modified_base (296)..(296): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggtttccttgttgctatttagaaggtgtccagtgtgaggtgcaggtggtggagtcgtgggggaancttggtacaggcctgggagggtccctgagactcttctgtgcagcctctggtattcgactttagagttangaaatgaactgggtccncaggctcgaggggagggctgggagtgggttacagtactatttcgtaagttaattcgtaggtaacccccataccactatgctaggtcctactggttggaaacggggtcctatttacccacctaacttcctacccgaagacgaacccgaaaccggaccccaaagggtaacccttaccttaacttttactaccgttacggaacaaaagtcggaaagccgaaggccctaggaaggtacggttaccggggaaggtacccgtaaggggtttatttaagttaaccgtgggtacggacggaaggtaagtacgttaggttcctaggtctacgtcgtcggttccggtacggtactaacttaacg

SEQ ID NO: 392884 - DNA, 604 bp, Homo sapiens
  misc_feature: GZ8MTXP02HPUHP.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaagcttggtacagccgtgggaggtccctgagacttcttctgtgcagcctcgtggattcgactttagtagttatgaaatgaacgtgggtccgccgaggctaccgaggggagggcgtggaggttgggtttacagttactatttttacgtaagttaacttcgtacggtaccccatactactatcgtcagttcctcgttggtggaaacgggggtcccgtaatttcccgacccgtattccctacccgaagaacgaccaaaccgccgaaggaacttctactttatctagacaaagtcgagcagcctagagagtcgaggtacaggtttattagttacgtggtcgagtagagtagttacgttcgtagtcgttatcggtaccgttcggggactacgttaatag

SEQ ID NO: 392885 - DNA, 585 bp, Homo sapiens
  misc_feature: GZ8MTXP02G2UPB.11.19.B08.1.454.CMB.2.raw
  modified_base (452)..(452): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagactcttctgtgcagcctcgtggtattcgtactttagtagttatagaaatgaacgtgggtccgcgaggctcgaggggagggctggagtggttcatactatttctaagttaattcgtaggtacccctatactactatcgactagtctcgtggtacgaacggggcctattccacctatctacccagacaccaacgcgaagactactactttacnctagacaaatgacgcagcctaggacgacgtacggaaggaccgtaggggttatttacgtacgtaggtgacggaagtacgtattacggtcttaggtctaagttcgtaccggttacggggactaactaacgtttag

SEQ ID NO: 392886 - DNA, 512 bp, Homo sapiens
  misc_feature: GZ8MTXP02JUE05.11.19.B08.1.454.CMB.2.raw
  modified_base (211)..(211): a, c, t, g, unknown or other
  modified_base (464)..(464): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttggtacagcctgggagggtccctgagactcttctgtgcagcctctggattcgactttagtagttatgaaatgaactgggtccgcaggctccgagggaggctggagtgggttcatacatttcagtatctggtaccccatacactatgcagtctctgtgagggccatcacatctccagagacacgcaggactctacttagtctgacaaatgagcagcctagagagtcgaggtacacgggttaattagttacgngtcgcagagtatacgtctgtctagtcgtcgttaccgggatctaactag

SEQ ID NO: 392887 - DNA, 531 bp, Homo sapiens
  misc_feature: GZ8MTXP02IDNJL.11.19.B08.1.454.CMB.2.raw
  modified_base (300)..(300): a, c, t, g, unknown or other
  modified_base (377)..(377): a, c, t, g, unknown or other
  modified_base (393)..(393): a, c, t, g, unknown or other
  modified_base (421)..(421): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtggggggaagcttggtacagcctgggagggtccctgagactcttctgtgcagcctcgtggattcgacttttagtagttatgaaatgaacgtgggtccnccaggctccgagggagggctggagtgggttcatactatttctagtatctggtaccccatacactatgcagtctctgngaggccattcacatcncagagacaacgccaggaactcactttanctagactaaaatcgagcacgcctagacgagtcggaaggacgtacgggttatttagtactggtgacgagagtattagtctagtctagtcgtcgttacgggatacctaatag

SEQ ID NO: 392888 - DNA, 588 bp, Homo sapiens
  misc_feature: GZ8MTXP02J1JTU.11.19.B08.1.454.CMB.2.raw
  modified_base (304)..(304): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcgaggtggtggagtcgtggggggaagcgttggtacagccgtgggacgggtccctggagtactcttctgtgcagcctctggattcgactttagtagttatgtaaatgaactgggtccncaggctccgagggaggggctggaggtgggtttcatactatttctagttaatctaggtaccccatacactatgcagtctcgtgtggacgggccgtattcaccatcctccagacgaacaacgccgacggtaactctaactttatctgactaaatgaagcaacgccgtagaacggtaggtacggacggtaccgtaaggggtttatttaacgttacgtgtacggacggaagagtatacggttcttacgtcgttacgtcggtaccggttaccggacgtacctaacgtcg

SEQ ID NO: 392889 - DNA, 534 bp, Homo sapiens
  misc_feature: GZ8MTXP02I2R36.11.19.B08.1.454.CMB.2.raw
  modified_base (297)..(297): a, c, t, g, unknown or other
  modified_base (439)..(439): a, c, t, g, unknown or other
  modified_base (452)..(452): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccnccaggctccgagggaggggctggagtgggttcatactatttctagttaattcgtgtacccatacactatgcagtctctggtgaacgggccgattcacctatcctaccaagacgacaaccgaccaacggaactctaactttanactgacaaatgancagcctagagagtcgaggactagggttattagtactgtcgagagagatacgtctgtcgtatcgtcgtcggatactaacgtag

SEQ ID NO: 392890 - DNA, 582 bp, Homo sapiens
  misc_feature: GZ8MTXP02FZAFY.11.19.B08.1.454.CMB.2.raw
  modified_base (462)..(462): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtgggtggagtcgtggggggaagcgttggtacaggccgtgggagggtccctgagacttcttctgtgcagcctcgtggtattcgactttagtagttatagaaatagtaacgtcgggtccgccaggctccgagggaaggggcgtggaggtggttcatactatttctagtattctcgtacctactacactatgcagtctcgtggtaggaacggccgtattccaccagttctacccgagaacgaccgaacgacccgagtaaacctctactttaancgtagactaaaatgacgacacgtcctaggagacggtacgaaggacgtaacgggttatttatacgtgtagcgaagatagtacgtctggtaactatggtaccgttcgggactacttaactag

SEQ ID NO: 392891 - DNA, 589 bp, Homo sapiens
  misc_feature: GZ8MTXP02IO9LL.11.19.B08.1.454.CMB.2.raw
  modified_base (277)..(277): a, c, t, g, unknown or other
  modified_base (295)..(295): a, c, t, g, unknown or other
  modified_base (432)..(432): a, c, t, g, unknown or other
  modified_base (445)..(445): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcctgttgctatttagagtgtccagtgtgaggtgcaggtggtggagtcgtgggggaagcgttggtacagccgtgggagggtccctgagactcttctgtgcagcctcgtggattcgacttagtagttangaaatgaacgtgggtccncgagctcgagggaagggctggagttggttcattactatttctaagtattcgtggtacccatacactatgcagtctctgtcgaagggccattcaccaatctccaagagaaccaacgtcccaaagaactctaactttanactagaactaaanagagacgacgacgacgagacggtacggacggaacggtaacggttaagtttaagttacgttagtaggtacgtaaggtaacgtacgtacgttcgttacgtaacgttacgttacggtacggttaccggtacgtacgttaacgtaacg

SEQ ID NO: 392892 - DNA, 728 bp, Homo sapiens
  misc_feature: GZ8MTXP02H3IM1.11.19.B08.1.454.CMB.2.raw
  modified_base (322)..(322): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtgggagtcgtgggggaagcttggtacagcctgggaggtccctgagtactcttctgtgcagcctgtggattcgtactttagtagttatgaaatgaactgggtccgccaggctcggagggagggctggngttgggttcatactatttctaagtattctaggtacccatacactagtgacagttctcttgtacggtaacggggcccgtattcccaacctactacctccgaagaacgaaaccgaaaccgacccaaacgggtaaaccttacctaaccttttataccgttaggtaaacctaaaagttacggtaacgacctaacgggtaccccttaaggaaacggtaacgggttaacccgggaaaggggtaacccgttaaacgggggtttaacctttttaaaaggtttaaccggttacggttagggtaaccggtaaagggtaaacggttaaagtttaaacggttccgttaggtttaacgttaacgttcggttacccgggtttacccgggggtaactaaccgttttaaaacgttaaaccgg

SEQ ID NO: 392893 - DNA, 633 bp, Homo sapiens
  misc_feature: GZ8MTXP02H7Z0W.11.19.B08.1.454.CMB.2.raw
  modified_base (212)..(212): a, c, t, g, unknown or other
  modified_base (263)..(263): a, c, t, g, unknown or other
  modified_base (456)..(456): a, c, t, g, unknown or other
  modified_base (489)..(489): a, c, t, g, unknown or other
  modified_base (571)..(571): a, c, t, g, unknown or other
  modified_base (581)..(581): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancgttggtacagccgtgggagggtccctgagtactcttctgtgcagcccttntggattcgactttagtattatagtaaatgaacgtcgggtccgccgtaggcgtccgagggagggcgtggaggttggttcagtactattcgtaagttaattcgtggtaccctatactacgtattcgctagttctcttggtacggtaacgggaccgtactttacacctaacttccacccaagacgaacccgaaacnccgaaacggtaaccttcaacctttttataccgngaaacctaaaagttcgagacgacgaccgttgaaaggacgtaggaacggtaaccgtaggttaacttttacgtaacgtggtcgngaaacggttntacgttacgttcgtagttaacgtacgtcggtacggtcggaactactaacgtg

SEQ ID NO: 392894 - DNA, 548 bp, Homo sapiens
  misc_feature: GZ8MTXP02F4QXI.11.19.B08.1.454.CMB.2.raw
  modified_base (210)..(210): a, c, t, g, unknown or other
  modified_base (295)..(295): a, c, t, g, unknown or other
  modified_base (427)..(427): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaagtgtccagtgtgaggtgcaggtggtggagtcgtgggggaancttggtacagccgtgggacgggtccctgagactcttctgtgcagcctctggattcgactttagtattatagaatgaactggtccncaggctcgagggaggctggagtggttcagtacatttctagtatcgtggtacccatacactatgactagtctctgtaggaacgggccgtattccacatctaccgagacgacaacgccagaactctactttacnctagacaaagtgacgacacgctaggagtacgtacggaagtacgtaggtttattagtacgtggtgacgtagacgtacgttagtcgtataacgtagtcgtacggtacggaactccgtaaatcg

SEQ ID NO: 392895 - DNA, 598 bp, Homo sapiens
  misc_feature: GZ8MTXP02GGBN7.11.19.B08.1.454.CMB.2.raw
  modified_base (282)..(282): a, c, t, g, unknown or other
  modified_base (300)..(300): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagacttcttctgtgcagcctctggtattcgactttagtagttanagaaatgaactgggtccnccaggctcgagggaaggctggagtggttcatactatttcagtaattctaggtaccccatacactatgcagtctctggtaggaaacgggccgtaatttccaacctattcctacccaaggacaaaccgaaacgtacccgaaggtaaacctctaactttatcctagaacaaaatgaacgcaacgcctagaggacgtcggaaaggaccgaacggggtttatttaaacgttacgtgtaggacgaaaggtacgattacggtcttaggtaacctagtcgtccgttaccgggatacctaaactacg

SEQ ID NO: 392896 - DNA, 541 bp, Homo sapiens
  misc_feature: GZ8MTXP02IPQ51.11.19.B08.1.454.CMB.2.raw
  modified_base (429)..(429): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccgccaggctccgagggaggggctggagtgggtttcatacatttctagtattctggtacccatacactatgcagtctctgtggaacgggccgtattccaccatctccagagacaacgcaggaactctaactttanctagacaaatgagcagcctggagagtcgaaggacgtaacgggttatttattacgtgtagacgtagagtatacgtcttaggtaactatcggtcgttacgggatcgtaaatacg

SEQ ID NO: 392897 - DNA, 635 bp, Homo sapiens
  misc_feature: GZ8MTXP02HUMFK.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctatttagaaggtgtccagtgtgaggtgcaggtggtggagtcgtgggggaagcttggtacagccgtgggagggtccctgagactcttctgtgcagcctctggattcgacttagtagttatagaaatgaacgtgggtccgccaggcctccgaggggaagggcgtgggagttgggttcagttactatttctaagttaattcgtacggtaccctaatactaactatcgacctagttcctcgtagtaggaacggggtcctattccacccattcctacccgaagaaccgaacaaacccgtacccgaaggtaaacctctaaacctttatacgtacaactaaaatgaacgcacgtcctagacgaggtcggaaggtacgtacggggtttaatttaacttacgtggttacgacgtaaaggagtagttacgttacgttgttaaccgttagtacggtccgttaccgggactaccgtttaaacttacgg

SEQ ID NO: 392898 - DNA, 544 bp, Homo sapiens
  misc_feature: GZ8MTXP02FLJ98.11.19.B08.1.454.CMB.2.raw
  modified_base (298)..(298): a, c, t, g, unknown or other
  modified_base (371)..(371): a, c, t, g, unknown or other
  modified_base (423)..(423): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagactcttctgtgcagcctctggattcgactttagtagttatgaaatgaactgggtccncaggctcgagggagggctggagtggttcagtactatttctagtattcgtggtacccatacactatgcagtctntgtgaacggccattcaccatctaccgagagacaacgccaagactctacttanctgacaaatgagcacgcctgagagtcgaggacgtagggttatttagtacgtgtagacgtaagaagtagttaccgtgttagtaacttagtcgtcccgttacggggactaccttaacttaacg

SEQ ID NO: 392899 - DNA, 581 bp, Homo sapiens
  misc_feature: GZ8MTXP02IWFCZ.11.19.B08.1.454.CMB.2.raw
  modified_base (444)..(444): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatagaaatgaacgtgggtcccgccgaggcctccgaggggaggggcgtggaggttgggtttcattactatttctagtattctggtaccccataccactatgcagtctctggtggaacgggccgattccactatctccagacgacaacgcaacggaactctactttanctagactaaagtgagcaggcctaggagtaggtcggaaggacgtaacgggttatttacgttacgtgtaggacgaaggtagtagttacgttcttgttaacctagtcggtccgttaccggggataccgttaaactttacg

SEQ ID NO: 392900 - DNA, 547 bp, Homo sapiens
  misc_feature: GZ8MTXP02GSTYB.11.19.B08.1.454.CMB.2.raw
  modified_base (300)..(300): a, c, t, g, unknown or other
  modified_base (401)..(401): a, c, t, g, unknown or other
  modified_base (425)..(425): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaagcttgggtacaggcctgggacgggtccctggagactcttctgtgcagcctctggattcgactttagtagttatgaaatgaactgggtccnccgaggctccggagggaggggctggagttgggttcatactatttctaagtattctggtacccatacactatgcagtctctgtgaagggccattcaccatcncagacacacgcagactctacttanctagacaaatgagacacgcctagagagtacggagtacgtacgggttattacgttacgtggtacgacggtagacgtagtacgtcgtagtctagtcggtacgttaccgggagtactaacttacg

SEQ ID NO: 392901 - DNA, 674 bp, Homo sapiens
  misc_feature: GZ8MTXP02G60QA.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcgaggtggtggagtcgtgggggaagcgttggtgcagccgtgggacgggtccctgagtacttcttcgtgtgctacgcctcgtggtattcgtactttagtagttatagaaatgaacgtcggtcccgcgaggccgtaccggaggggaacggggcgtagggtaggttgggtttacaagttactatttacgtaagttaacttcgtacggtaaccatactactagtgactagtctcgtggtacggaacggggcctattaccaacctactacctaccgaagacgaacgaaccgaccgaacggtaaacctactactttactacgtacgaaactaaagttgaacgcgaaacgccgtaaggacgtaacgggacggaaggtaacgtaacgggtttaattttaacgtacgtggtacgtacggaagtacgtaaattacggtcgttaaggtacttaacggttcggtacccggtttaccggggaacgtacctttaaaacgg

SEQ ID NO: 392902 - DNA, 550 bp, Homo sapiens
  misc_feature: GZ8MTXP02F1M5O.11.19.B08.1.454.CMB.2.raw
  modified_base (211)..(211): a, c, t, g, unknown or other
  modified_base (301)..(301): a, c, t, g, unknown or other
  modified_base (438)..(438): a, c, t, g, unknown or other
  modified_base (450)..(450): a, c, t, g, unknown or other
  modified_base (525)..(525): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttggtacagcctgggagggtccctgagactcttctgtgcagtcctcgtggtattcgactttagtagttatagaaatgaacgtgggtccncgaggctccgaggggaaggggctggagtgggttcagtactatttctagtaattcgtaggtaccccatacactatgcagtctctgtgacggggtccattcaccatctccagaacgacaaccgcagaactacactttanctgacaaatgancacgctagaggtacgcggaacggacgtacgggttaatttaatacgtaggtagtaggaagtagtatacgtctagtntacgtcgtcgtacggatactacgta

SEQ ID NO: 392903 - DNA, 541 bp, Homo sapiens
  misc_feature: GZ8MTXP02IOC3D.11.19.B08.1.454.CMB.2.raw
  modified_base (213)..(213): a, c, t, g, unknown or other
  modified_base (375)..(375): a, c, t, g, unknown or other
  modified_base (396)..(396): a, c, t, g, unknown or other
  modified_base (426)..(426): a, c, t, g, unknown or other
  modified_base (438)..(438): a, c, t, g, unknown or other
  modified_base (503)..(503): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancttggtacagccgtgggacgggtcctgagactcttctgtgcagtcctctggattcgactttgtagttatgaaatgaacgtggtccgccaggctccgagggaggggctggagtgggtttcatctatttctagtattctaggtacccatacactatgcagtctntgtggaggccgtattcaaccntctaccagacgacaacgcagaactctattnctgacaatgagntacgacctgacgagtacgaaggacgttacgggtatttattacgtgtgacgtagagtactacgttntagtcgttagtcggtacgtacgggtactactaactacg

SEQ ID NO: 392904 - DNA, 625 bp, Homo sapiens
  misc_feature: GZ8MTXP02I1713.11.19.B08.1.454.CMB.2.raw
  modified_base (321)..(321): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctatttagaggtgtccagtgtgaggtgcaggtggtggagtcgtgggggaagcgttggtacagcctgggacgggtccctgagactcttctgtgcagcctctggattcgactttagtagttatgaaatgaacgtgggtccgccaggctccgagggaagggctggngttgggttcagtactatttctaagtattctcggtacccatacactatgccagtctcgtgtaggaacggccgtattccacctatcctacccaagaacgaacaaacgccaacggtaaactcctaacttaattctacggtaacaaagtacgtagaccgtagcccgtaggacggtaaggtcggaaagggacccgttaaagggttaacgttttaagtttaacgtggttaggacggaggtaagtacgttaaagttcgttaagtccgttagttagtacccggtttacggacggtaccttaaacgtttaacg

SEQ ID NO: 392905 - DNA, 617 bp, Homo sapiens
  misc_feature: GZ8MTXP02I2MWF.11.19.B08.1.454.CMB.2.raw
  modified_base (263)..(263): a, c, t, g, unknown or other
  modified_base (286)..(286): a, c, t, g, unknown or other
  modified_base (471)..(471): a, c, t, g, unknown or other
  modified_base (486)..(486): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaggtgtccagtgtgaggtgcaggtggtggagtcgtgggggaagcgttggtacagccgtgggacgggtccctgagacttcttctgtgcagtcctntggattcgtactttagtagttanagaaatgaacgtgggtccgcaggcctaccgaggggagggctgggtagttgggttacagttactattttactaagttattcgtcggtaccccataccacttatgacctagtctcgtggtacgaacggggcctacttcgacctatcctaccagacgaaccaacgaccaaggtaactctaactttacnctagactaaatggancgacgccgtagaagtaggtacggaaggtaacgtaacgggtttaatttacgttaactggttgacggaagtagtacgttaagttccttagtaaccgttagtacggtccggttacggtacgtacttaacttacg

SEQ ID NO: 392906 - DNA, 585 bp, Homo sapiens
  misc_feature: GZ8MTXP02H8692.11.19.B08.1.454.CMB.2.raw
  modified_base (212)..(212): a, c, t, g, unknown or other
  modified_base (303)..(303): a, c, t, g, unknown or other
  modified_base (326)..(326): a, c, t, g, unknown or other
  modified_base (415)..(415): a, c, t, g, unknown or other
  modified_base (432)..(432): a, c, t, g, unknown or other
  modified_base (435)..(435): a, c, t, g, unknown or other
  modified_base (445)..(445): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancgttggtacaggccgtgggagggtccctggacgactcttctgtgcagcctctggattcgactttagtagtatagaaatgaacgtgggtccncgaggctccgagggaaggctggngttggttcatactatttcaagttaatcgtagaacccctatacactatgacagtcctgtgtgaagggctatcacatcacagagaacaacnccaagactacactttancanacaagtgacncacgactaggaagacggtacggaacggtaacgttacgggtttaaaatttaacgttcgtaggttaggaacgtaagaagttaacgttcgttaccttgttaacgtacgtcggttacccggtacggtacgttaactaaacgtcg

SEQ ID NO: 392907 - DNA, 639 bp, Homo sapiens
  misc_feature: GZ8MTXP02GZ5DN.11.19.B08.1.454.CMB.2.raw
  modified_base (211)..(211): a, c, t, g, unknown or other
  modified_base (309)..(309): a, c, t, g, unknown or other
  modified_base (473)..(473): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctattttagaaggtgtccagtgtgaggtgcaggtggtggagtcgtgggggaancgttggtacagccgtgggacgggtccctgacgtacttcttctgtgcacgtcctcgtggtattcgtaactttagtagttatgaaatgaacgtgggtccncaggctcgagggaggctggagtgggttcatagtatttactagttatctaggtaccccctatacacttatcgcagttctcgtggtaggaacggggcctatttaccacctacgtcctacccgaagtaacgaaccgaacccgaccgaacgaaccttactactttacnctacgtacaaaatcggaagcacggtaccgtaggacggtagttaccgggaaacggacgtaacggggtttatttaagttacgtggtaggacgtaaggtagtacgttacgtcgtttaggtaacccgttagtacggttcccggttacggggacttaccgttaaacgttcg

SEQ ID NO: 392908 - DNA, 641 bp, Homo sapiens
  misc_feature: GZ8MTXP02IZ4U6.11.19.B08.1.454.CMB.2.raw
  modified_base (270)..(270): a, c, t, g, unknown or other
  modified_base (291)..(291): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcgaggtggtggagtcgtgggggaagtcgttggtacaggccgtgggagggtccctgacgacttcttctgtgcagcctcgtggnttcgtacttagtagttagtanaaagtagacgtgggtccgccgaggctaccggagggaaggggcgtggtaggtgggttcgtatacttattcttaatagtttctgtaccctactactactatgtctagtctcctggtacgtacggggacgtactctacccaatcctaccgaagacgaaccaacgaccaggaacctactacttactacctagataaacgtgacgacgcgtaaccctggaagtacggtacgaacgggaacccgtacggggtttaatttaactttacgtaggtggaccggaaagggtatacgttaagttaccgttgttaaaccgttgttcggtaccgtttacggggacgttaccttaaaagttacg

SEQ ID NO: 392909 - DNA, 546 bp, Homo sapiens
  misc_feature: GZ8MTXP02G3BHJ.11.19.B08.1.454.CMB.2.raw
  modified_base (257)..(257): a, c, t, g, unknown or other
  modified_base (348)..(348): a, c, t, g, unknown or other
  modified_base (403)..(403): a, c, t, g, unknown or other
  modified_base (432)..(432): a, c, t, g, unknown or other
  modified_base (435)..(435): a, c, t, g, unknown or other
  modified_base (437)..(437): a, c, t, g, unknown or other
  modified_base (440)..(440): a, c, t, g, unknown or other
  modified_base (446)..(446): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggtttccttgttgctattttagaaggtgtccagtgtgaggtgcaggtggtggagtcgtgggggaagcttggtacagccgtgggagggtccctgagactcttctgtgcagcctntggattcgactttagtattatgaaatgaactggggtccgccgggctccgaggggagggctggagtggtttcagtactatttctagtaattntaggtaccaataccattatgacagtctcttgagaaggggccctaattcaccatcnccagagaacacgcctagaactcaatttancananaanagaganagacgagagagacgacgacgtagttagttagtagtcgtgagagagtacgtacgtcgtgtacgtaagtcgtacgtacggtacgtacgtaacgtaacgtacg

SEQ ID NO: 392910 - DNA, 760 bp, Homo sapiens
  misc_feature: GZ8MTXP02F85NR.11.19.B08.1.454.CMB.2.raw
  modified_base (265)..(265): a, c, t, g, unknown or other
  modified_base (289)..(289): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttcctgttgctattttagaggtgtcagtgtgaggtgcgaggtggtggagtcgtgggggaatcgttaggtacagccgtgggacggtccctgacgtacttcttcgtgtgcgacgtcctntggtacttcgtactttagtattanagaatgaacgtgggtccgacgaggctaccggagggagggctggtaggttggttacattacgtattttacgtaagttacttcgtacggtaaccctaacgtactacttagtctaccgttagttccgttagtgggttacggaaacggggtcccctaagtttcccaaacctacttccgtaacccgaagggtaaacgaaacccgaacgtaaccccgtaacgggtaacctttaccgtttaacttttaacgctttaacggaaacaaacggttggaaacccgactaccggtaccgtaagggaacgtaacggtaccggggtaaaggaaccgggtttaaaccgggtttaatttttaaacgggttaccgttcgggtaggtaaaccggtaaaggttaaacggtactttaacggggttccttacggtttaagtaacggttccgttaccgggtaccggtaaacgtttaacctaagtttaaaccgg

SEQ ID NO: 392911 - DNA, 618 bp, Homo sapiens
  misc_feature: GZ8MTXP02IZL9X.11.19.B08.1.454.CMB.2.raw
  modified_base (205)..(205): a, c, t, g, unknown or other
  modified_base (253)..(253): a, c, t, g, unknown or other
  modified_base (296)..(296): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggtttctgttgctatttagaggtgtcagtgtgaggtgcaggtggtggagtcgtgggggaancttggtacagccgtgggagggtccctgagtactcttctgtgcagcctntggtattcgtactttagtagttatagaaatgaacgtgggtccnccgaggctccgaaggggagggctgggagttgggttacaattactatttctaagttaacttcgtggtaacccctatacactatgacagtctctggtagtacgggaccgtattccgacctaatcctaccgaagacgaaacgaacgaccaacggaacctactaacctttagcttaagactaaaagtcgagacagaccgtagaacggacgtacgggaacggaccgtaacggggttatttaacgttacgtggttacggacgtaaggacgtagttacgtcgtacgttaactaagtcggtacgttacccgggaataccgtaaactacgg

SEQ ID NO: 392912 - DNA, 562 bp, Homo sapiens
  misc_feature: GZ8MTXP02FMRIK.11.19.B08.1.454.CMB.2.raw
  modified_base (301)..(301): a, c, t, g, unknown or other
  modified_base (440)..(440): a, c, t, g, unknown or other
  modified_base (454)..(454): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggagggtccctgagacttcttctgtgcagcctctggattcgacttttagtagttatagaaatgaactgggtccncaggctccgaggggagggctggaggttgggttcatactatttctaagtaattcgtaggtaccccatacactatgcagtctctggtgaacgggcctatccaccatctccagacgacaacgaccaggtaactctactttanctagacaaatcgancacgcctagagacgtcggaaggacctagggttatttacttacgtgtgacgaagtacgtattacggtctaggtaacttagtcgtccgttcggggactaacctaattacg

SEQ ID NO: 392913 - DNA, 667 bp, Homo sapiens
  misc_feature: GZ8MTXP02IW4PP.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgctattttagaaggtgtccagtgtgaggtgcaggtggtggagtcgtgggggaatcgttggtacagccgtgggacgggtccctgacgacttcttctgtgcagcctcgtggtattcgactttagtagttatagaaatgaacgtgggtcccgccgaggtcctacggaaggggaggggctgggtagttgggtttcattactattttacgtaagttaacttcgtacgtaccccatacactatcgctagtctgtggtacggaacggtcctaattccaacctacttctacccgaagaacgaaccgaaaccgaccgtaaacgtaaccttactaactttactactagaaactaaagtgaagccagccgtagaggtacgtacggaacggtaacgttaacgggttaatttaacgttacgtaggttggaacggtaaggtaagttaagttaacgttcgtttacgttaacgttacgttcggttacccggttaccgggggtaacttaccgttaaaacgttaacg

SEQ ID NO: 392914 - DNA, 720 bp, Homo sapiens
  misc_feature: GZ8MTXP02J01U0.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagccctgtggtattcgtactttagtagttatagaaatgaacgtgggtccgccgaggcctccggaggggaacggggctaggggaggttcggggtttacagttactatttactagtaattcgtaggtaccccatacactatgctagtctctggtaggaacggggcctagttccaaccctattcccgtaccaaggaacgaacccgaaacccgaccgaaacgggtaacccttaccttaacgtttttaactccgtagtaaacctaaaagtacggaaccgaccgacggtacccgttaggaacgggtaacgggttaccgggaagggtaaccccggtttaaacgggggttttaattttaacccggtttaacggtgggttacgggaaccggtaaggtaaacggttatttaacgggttccgtttagtaacgttagtttccgtccggttttacccgagtaaccggtaaccctttaaacg

SEQ ID NO: 392915 - DNA, 767 bp, Homo sapiens
  misc_feature: GZ8MTXP02G5CGC.11.19.B08.1.454.CMB.2.raw
  modified_base (213)..(213): a, c, t, g, unknown or other
  modified_base (317)..(317): a, c, t, g, unknown or other
tcagcgagagataccacgaccggtgctcgatttagtgagtcagtaagggctcagagaggtgccttagccctggattccaaggcatttccacttggtgatcagcactgaacacagagactcaccatggagttggggctgtgcttgggttttccttgttgcttattttagaaggtgtccagtgtgaggtgcaggtggtggagtcgtagggggaancttggtacagccgtgggacggtccctgagtacttcttcgtgtcgcgacgcccttcgtggattccgtacttttagtaagttatagaaatgtaacgtcgggtcccnccgaggccctccgggaaaggggacggggcgttggagttgggtttcaattaacgtatttcaagttaattcgtaggtaccccaataccactatcgactacgttctcttggtacggaacggggtaccctaatttcccaaaccgtactttacccgaccgaaacgtaacgaacccgtaaacccgaccgtaaacggtaaacccttacgttaaacttttacgccgttaaggtaaacctaaaattcgggacgacctaccggtacccgtaaggggaacgtaacgggttcggaaaacggggtaacccgttaaaggggttttaaacttttaacggttaacgttgggttaaccggaacggtaaaggttaggttaaacgtttaaccgggttactttacggtaacgttacggtacccggtttacggttacccggtaaacgttaaccgtttaaacggtttaacgg

SEQ ID NO: 392916 - DNA, 715 bp, Homo sapiens
  misc_feature: GZ8MTXP02F6RPS.11.19.B08.1.454.CMB.2.raw
tcagcgagagataccacgaccggtgctcgatttagtgagtcagtaagggctcagagaggtgccttagccctggattccaaggcatttccacttggtgatcagcactgaacacagaggactcaccatggagttgggctgtgcttgggttttccttgttgctattttagaaggtgtccagtgtgaggtgcgaggtggtggagtcgtgggggaagtcgttggtacacggccgtgggacgggtccctagacgtacttcttcgtgtcgcacgtcctcgtaggtacttacgtacttttagtagttatagtaaagtgaacgttcgggtccaccgaggtcctacggaggggaaggggctaggggagtttgggtttacagttactacttttactaagttaacttcgttacggtaaccctaataccgtaactacgttgacctagttcctcgtggtacgggtaacggtccgtaattacccgaacctactacctacccgaagaacgaaaccgaaccgaaccgaacgtaaccttacttaacttactcgtaacgacttaaagcgtacgacgtacggacgtaacggaggtaacggtacggaacggttacgtaacggggttttaatttacgtacgtagggttacggacggtaagtaacgtacgttaacgttcgtttacgtaactttaacggtcggttacccggttaccggattaacgtttaaccttaaggg

SEQ ID NO: 392917 - DNA, 721 bp, Homo sapiens
  misc_feature: GZ8MTXP02FR4JW.11.19.B08.1.454.CMB.2.raw
  modified_base (501)..(501): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaaggtgtccagtgtgaggtgcaggtggtggagtcgtgggggaagcgttggtacagccgtgggagggtccctgagactcttctgtgcagcctcgtggattcgtactttagtagttatagtaaatgaacgtgggtcccgccgagggtcctaccggaaggggaaggggctggggtagttggggttccaagtacctattttcgtaagtaatttcgtacggtacccctatacacttatcgactagtctctggtagaaacggggtccgtaatttccaacctagtcctacccgaagaacgaacgaacccgaccgaacgggtaaccctacttaacttttacncgttacgaaccgtaaaatacggaacgtacccgaaggtaccccgttaggaaacggtaacgggtacccgggtaaaaggggtacccgtaaagggggtttaaccttttaaggttaaaccgttgggttaggaaccgggtaaggtacggttaagttcggttacgttcggtaaccgtttaagtcggttaccgggttacccgggagtaaccccgtttaaacgttacgg

SEQ ID NO: 392918 - DNA, 614 bp, Homo sapiens
  misc_feature: GZ8MTXP02GC65H.11.19.B08.1.454.CMB.2.raw
  modified_base (308)..(308): a, c, t, g, unknown or other
  modified_base (542)..(542): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggtttccttgttgctatttagaaggtgtccagtgtgaggtgcgaggtggtggagtcgtgggggaagcgttggtacagccgtgggacgggtccctggacgtacttcttctgtgcagtcctcgtgtattcgtactttagtagttatagaaatgaacgtcggtaccncgaggctccggagggagggcgtaggaggttgggtttacattacgtatttacgtaagttaacttcgtacgtaccctatacctactatgactagtctcgtcggtaggacggtccgatttccactactctacagacgacgaacgacacgtactactattactctagacaaagtcgagacgacgaccgtagagtacggtcggaaaggtacggtaacgggttatttagtaacgttgganacgggtagtaacggtagttacgttacgtagttaacttagtacggttaccgtacggtactacgtaacttaacg

SEQ ID NO: 392919 - DNA, 646 bp, Homo sapiens
  misc_feature: GZ8MTXP02GTUOY.11.19.B08.1.454.CMB.2.raw
  modified_base (302)..(302): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagccgtgggacgggtccctgagactcttctgtgcagcgtctggattcacctttagcagctatgccatcgaccgtgggtcccnccgaggccgtaccggaaggggaggggcgtgggaggttgggtctcgagtctagttagtgtagtaggtggtaggtacgcaacatactacgcgacgtaccgtccggaggacggggtcccgttacacctatcctaccgagaacgtaactaacttcccaagtacgaaaccgtcgtaccttagtactcgtagaactaaaagtacggaaactacgccgtaggacggacggaccggaacggtaccgaccgggtaccgttaattacgttaccggtgggttacgacccggtagtaaacggttaagttaacggttacggtttagggttaacgggttcggggtttaggttaacggg

SEQ ID NO: 392920 - DNA, 567 bp, Homo sapiens
  misc_feature: GZ8MTXP02GXTAR.11.19.B08.1.454.CMB.2.raw
  modified_base (296)..(296): a, c, t, g, unknown or other
  modified_base (482)..(483): a, c, t, g, unknown or other
  modified_base (485)..(485): a, c, t, g, unknown or other
  modified_base (487)..(487): a, c, t, g, unknown or other
  modified_base (489)..(489): a, c, t, g, unknown or other
  modified_base (514)..(514): a, c, t, g, unknown or other
  modified_base (532)..(532): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctggagggtccctgagactcttctgtgcagcctctggattcgactttagtagttatgaaatgaactgggtccnccaaggctccgaggggaaggggctggagtgggtttcatacatttcaagttaattcgtggtaaccccataactactatgccagtctctgtaggaacggtccgatttaccacctaatcctcccaagacgaaacaaacgaccgtaacggaacctctaaccgtttataccttaggaacctaaaagtagannancngngagagagacgagtagttatacgtgngacgagagtacgtacgtntagtaagtacgtacgtcgtacggacgtactactag

SEQ ID NO: 392921 - DNA, 536 bp, Homo sapiens
  misc_feature: GZ8MTXP02JCBAK.11.19.B08.1.454.CMB.2.raw
  modified_base (212)..(212): a, c, t, g, unknown or other
  modified_base (422)..(422): a, c, t, g, unknown or other
  modified_base (437)..(437): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancgttggtacagccgtggagggtccctgagactcttctgtgcagcctctggattcgactttagtagttatgaaatgaacgtgggtccgccaggctcgagggaggctggagtggttcatactatttcagtaattcgtaggtaccccatacactatgcagtctctgtggaggcctattccacatctacagacgacaacgcagactctacttanctgactaaagtgacncacgtcctagagacgtacgacggacgtacgggttatttagtacgtgtagacgtagagtatacgtctgtaactagtcgaccgttcgggatactaagtacg

SEQ ID NO: 392922 - DNA, 660 bp, Homo sapiens
  misc_feature: GZ8MTXP02JC9L9.11.19.B08.1.454.CMB.2.raw
  modified_base (303)..(303): a, c, t, g, unknown or other
  modified_base (390)..(390): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttcctgttgctatttagaaggtgtccagtgtgaggtgcaggtggtggagtcgtgggggaagcttggtacagccgtgggacgggtccctgagacttcttctgtgcagtcctcgtggtattcgtacttagtagttatagaaatgaacgtgggtccncgaggctcgagggagggctggagtgggttcattactatttactagttaacttctacggtacccctatacactatcgactagtccgtntggtacggacggcccgtatttcccacctactccgtaccaagacgaaccaaccgtacccgaaagtaaccttcgtaactttactacctagaaccaaaagtgaaacgtcgtaaacgtccgtaggaacggtacggtaccggtaacgggtacgttaaccggggtttaattttaaacgtttacgtagggtacggacggtaaagacggttaattacggttccgttagtaacgttacgttcggtaccgtttacggggacttaacgttaacgttaacgg

SEQ ID NO: 392923 - DNA, 585 bp, Homo sapiens
  misc_feature: GZ8MTXP02IK1JK.11.19.B08.1.454.CMB.2.raw
  modified_base (247)..(247): a, c, t, g, unknown or other
  modified_base (276)..(276): a, c, t, g, unknown or other
  modified_base (373)..(373): a, c, t, g, unknown or other
  modified_base (453)..(453): a, c, t, g, unknown or other
  modified_base (470)..(470): a, c, t, g, unknown or other
tcagcgagagataccacgaccggtgctcgatttagtgagtcagtaagggtctcagagaggtgccttagccctggattccaaggcatttccacttggtgatcagcactgaacacagaggactcaccatggagttgggctgtgctgggttttcctgttgctattttagaaggtgtccagtgtgaggtgcaggtggtggagtcgtgggggaagcttggtacagcctggagggtcctgagactcttctgtncagcctctggattcgactttagtagttanagaaatgaactggtccgccaaggctccgaggggaagggctggagttgggtttacagtactagtttctaagtaattcgtagtaccccatacactatgnagtctcgtagtggaagggtcccatttcaacccgtattcccacgaagacgaccaaaccgaccaggaaacctctaactttanacctagactaaaatgancacgactagagtagtcgacggacgtacgggttattaacttacgtggttagacggtagaagtagtacgttcgtaagtcttaagtcgtaccgttaccggggatactttaactaacgg

SEQ ID NO: 392924 - DNA, 694 bp, Homo sapiens
  misc_feature: GZ8MTXP02HB561.11.19.B08.1.454.CMB.2.raw
  modified_base (212)..(212): a, c, t, g, unknown or other
  modified_base (301)..(301): a, c, t, g, unknown or other
  modified_base (480)..(480): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancgttggtacagcctggacgggtccctgagactcttctgtgcagcctctggtattcgtactttagtagttatgaaatgaacgtgggtccncgagctcgagggaggctggagtggttcatactatttcgtagttaatcgtacggtaaccccatacactatcgacagttctcgtggtacgggaacggggtcctattaccacccgtaattcccgaaacccaaggaacgtaaacccaacccggaccgaaacgggtaaccttactacctttaanccgttacgaactaaaagtggagaccgtaggaccccgtagggaacggtacggtaaccggggaagggtaccggttaacgggggttttaaactttaacgtttacggttacggggtagggaacggtaaggtaacggttaacgttacgttcgtttacggtaacggtttacggtaccggtttaccggttaaccgggtaacgtttaccttaaaacgtacgg

SEQ ID NO: 392925 - DNA, 600 bp, Homo sapiens
  misc_feature: GZ8MTXP02FNAYF.11.19.B08.1.454.CMB.2.raw
  modified_base (401)..(401): a, c, t, g, unknown or other
  modified_base (475)..(475): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacaggccgtgggacgggtccctgacgactcttctgtgcagcctcgtggtattcgtactttagtagttatagtaaatgaacgtcggggtccgccgaggcctaccggaggggaaggggtcgtgggtaggttggggtttacattactattttactaagtaacttcgtaggtacccctatacactangtcagtctgtggtgaacgggcctattccacctatctaccgagacaacgaaccgccacggtaactctactttacnctagacaaatgacgcagccagacggacgtacggacggtacgaacgggtttatttaacgttacgtggtcggacgaggtatagtacgtcttgtccttagtcgtacgttaccgggatcctaaacgtag

SEQ ID NO: 392926 - DNA, 589 bp, Homo sapiens
  misc_feature: GZ8MTXP02JLVQW.11.19.B08.1.454.CMB.2.raw
  modified_base (326)..(326): a, c, t, g, unknown or other
  modified_base (482)..(482): a, c, t, g, unknown or other
  modified_base (485)..(485): a, c, t, g, unknown or other
  modified_base (495)..(495): a, c, t, g, unknown or other
  modified_base (559)..(559): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttggggttttccttgttgcttattttagaaggtgtccagtgtgaggtgcagggtggtggagtcgtggggggaatcgttgggtacaggcccgtggggacgggttccctggagtacttcttcgtgtgaccagtcctcgtggtattcgtaactttagtagttatagaaatgaacgttcggggtccnccgaggctccggaggggaggggctgggagtgggttcaagttctatttacgtagtaattcgtagtaacccctagtacactatgacagttctcgtggtacggaagggcctactccaactactctaccgagacgacaacgaccaaggactactattacntanataaatgaancagctagagagtacggagacgtacggttatacgttagtcgtagacgagacgtatacgtcgttancgttagcgttacgtacggactacgttatag

SEQ ID NO: 392927 - DNA, 638 bp, Homo sapiens
  misc_feature: GZ8MTXP02GIJTR.11.19.B08.1.454.CMB.2.raw
  modified_base (297)..(297): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacagcctgggagggtccctgagactcttctgtgcagcctctggattcgactttagtagttatgaaatgaactgggtccncaggctcgagggagggctggagtgggttcatacatttctagtaattcgtggtacccatacactatgctagtctctggtagaacggggccgatttaccaaccctatcctaccgagacgacaaaccgccaaggtaactcgtactttatctacgactaaaatgaacgctacgggaccctaggaacggacggttacggaagggtaaccgtaacgggggttttaattttaaacgttaacgttggttacggacggtaaaggtacgtaagttaacggttccgtttaggtccgtttaaagttcggttaccggttaccgggggaactttacccgtaaaacgtttaaccgg

SEQ ID NO: 392928 - DNA, 566 bp, Homo sapiens
  misc_feature: GZ8MTXP02F771P.11.19.B08.1.454.CMB.2.raw
  modified_base (300)..(300): a, c, t, g, unknown or other
  modified_base (372)..(372): a, c, t, g, unknown or other
  modified_base (437)..(437): a, c, t, g, unknown or other
  modified_base (443)..(443): a, c, t, g, unknown or other
  modified_base (446)..(446): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacaggcccgtgggagggtccctgagactcttctgtgcagcctctggattcgatttagtagttatgaaatgaacgtgggtccncgagctcgagggagggctggagtggttacagtactatttctaagtaattcgtaggtacccctatacactatnctagtctctggtgaacgggcctattcacctatcctaccagacacaaccgcagaactctatttacnctaganaangacgcagtcgagagtacgacggacggtacgtacggtttaattagtacgtggtagacggtaagtacgtacgtacgtcgtacgtaacgtagtcggtaccggttacggactacgttaactacg

SEQ ID NO: 392929 - DNA, 834 bp, Homo sapiens
  misc_feature: GZ8MTXP02JJ37U.11.19.B08.1.454.CMB.2.raw
  modified_base (211)..(211): a, c, t, g, unknown or other
  modified_base (401)..(401): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaaggtgtccagtgtgaggtgcaggtggtggagtcgtgggggaancgttggcacgcgtcggtagggtaccgtcgagactacttcgttgtgtcgcgtccgtcgttggtgttacgttacgttagtttaagttattagtaaagtagtaacggtacggtccggaccgacggacgtccggtacggggaagggggtacgggtacggtagggttcgggtttacgttactacgttaacgtttntttaaacgttaagttaccgtttacggtacccgtactaactactaactgtacgtaacgtgttccttggtacgggtaacgggaccggttacttactaccctaaaccttcgttacccgaagaaacggaccaaaacccgaccccgtcggttaaaaactcccttaatttactttaacggctaaacgtaaaatttagggacgtaccccgaaagttcccggtccggttaaaaagggggtacgggttaacccggggaacggttaaaccggtttaaaacggggttttaaatttttaccgttaaaacgggttgggtaccgggtaaacgggtaaggggttaaatttaaccggttacggtttccgtttaggttaaccggttaacgtttccggggtaaccccggggtttaccgggaaacggtttaaccttaaacgttttaaaccgg

SEQ ID NO: 392930 - DNA, 713 bp, Homo sapiens
  misc_feature: GZ8MTXP02I1Q9Q.11.19.B08.1.454.CMB.2.raw
  modified_base (316)..(316): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgtcttgggttttccttgttgcttatttagaagtgtccagtgtgaggtgcgaggtggtggagtcgtgggggaatcgttggtacagccgtgggacgggtccctgagtacttcttcgtgtgcacgtcctcgtggtacttcgtactttagtagttatagtaaatgtaacgtcgggtcccnccgaggtcctaccgggaaggggagggtcgtagggtaggtttgggttacaagttactagttttacgtaagtttaacttcgtacggtaacccctattacgtacttacgtgtacctacgttcgttcgtggtacggaaccgggtccgtacttaccaacctactcctacgaagacgaacccgtacgaccgtaaacgtaaccttcgttaaacctttatacgtacgtaaacctaaagtcggtaacaccgtacggtaccgtaggaacggtaacggtacgggaaaacggttaccgttaagggtttaactttacgttacgtaggttacggacgtaaagtagttacgtacgttaccgttagtaaccgttagtccggttaccggtacggaacttacttaacgttaacgg

SEQ ID NO: 392931 - DNA, 542 bp, Homo sapiens
  misc_feature: GZ8MTXP02G8HH4.11.19.B08.1.454.CMB.2.raw
  modified_base (211)..(211): a, c, t, g, unknown or other
  modified_base (297)..(297): a, c, t, g, unknown or other
  modified_base (343)..(343): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttggtacagcctgggagggtccctgagactcttctgtgcagcctcgtggattcgactttagtagttaatgaaatgaactggtccnccaggctccgagggaaggctggagtggttcatacatttcaagtatntaggacccatacacatgcagtctctggtgaagggtcccagttaccaccatcctaccagacgaaccaagaccaggaactacactttatctagacaaatgagcagcctagagtaggacgagaacgtacggtatttaactagtagtcgacgtagagtatacgtcgtgttaacctagtcggtcgtaccggagacctaacgtag

SEQ ID NO: 392932 - DNA, 792 bp, Homo sapiens
  misc_feature: GZ8MTXP02HV5JU.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttcctgttgcttattttagaaggtgtccagtgtgaggtgcgaggtggtggagtcggtgggggaagtcgttggtacagccgtgggacgggtccctggagtacttcttctggtgcacgtcctgtggtattcgtactttagttagttatagtaaagtgtaacggtgggtcccgaccgagggtcctaccgggaaggggaacggggtcgttaggggtaggtttcggggttttacaacgtttaacttaagtttttaccgtaaagttttaaactttccggttacggtaacccctaacttaacctaacttagtgtacctaacgttccttacggttaggtagggtaacccgggggtaccttacttacccaaccgttacttacccgtacccgaaaggaaccgtaaacccggaaacccggtaacccggtaaacgggttaaaccctttacccgtttaactttttaccgtacgttaacggtaaactaaaacgttcgggaacgtaccgacggtacccgtaggaacgggacgttacgggaaacgggttaaccttaggggtttaaatttacggtttacgagggttcgaaacggtaggaaattcgtaacgttcgttgtaacgtagttccggttacggtacgggtactacttacgtttagg

SEQ ID NO: 392933 - DNA, 661 bp, Homo sapiens
  misc_feature: GZ8MTXP02HKM6N.11.19.B08.1.454.CMB.2.raw
  modified_base (211)..(211): a, c, t, g, unknown or other
  modified_base (299)..(299): a, c, t, g, unknown or other
  modified_base (448)..(448): a, c, t, g, unknown or other
  modified_base (501)..(501): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctattttagaaggtgtccagtgtgaggtgcaggtggtggagtcgtgggggaancttggtacagcctgggaggtccctgagactcttctgtgcagccctcgtggattcgactttagtagttatagaaatgaacgtgggtccnccgaggtcctaccgaggggaaacggggtcgtagggtaggtttcggggtttcaattaacgttattttacgttaagttaaatttcgtaggtaacccctaagtaccacttatgcctagtccttctggtaggaacgggcccgtattccaaccntctacccgaagaacgaaccaaccgacccgaaggtaacccttactaactttacnctacgaactaaaagttcgaacgaccaggtccttaaggacgtacggtaccggaacgggtaccgtaacggggtttatttaaaccgttcgttaggcgtacggaagacgtagtacggttctgttaacctagttcgtacggttaccgggactacttaaaacgttg

SEQ ID NO: 392934 - DNA, 682 bp, Homo sapiens
  misc_feature: GZ8MTXP02JJLSO.11.19.B08.1.454.CMB.2.raw
  modified_base (303)..(303): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaaggtgtccagtgtgaggtgcaggtggtggagtcgtgggggaagcgttggtacagccgtgggacgggtccctgagacttcttctgtgcacgcctctggattcgtactttagtagttatgaaatgaacgtgggtccncaggctccgaggggaagggctaggagttgggttcaagtactattttctaagtaattctaggtaaccccataccactatcgactagtctctgttaggaacgggtccgtaatttcccgaccctaaacttcccgtacccgaaacgggaaacgtaaaccccgaaacccggtaccccgaaaacggggtaaaccctttacccgttaaacctttttactacccgtttaagggaaccctaaaaagtcggaacggttacaccgggtacccttagggaacggacggttaccggaggtaaccgtaacgggtttaatttacgtacgtttagcgacgtagaggtacttagtccttagtcgtagtcgtcgttacgggactaccgttaagtacg

SEQ ID NO: 392935 - DNA, 765 bp, Homo sapiens
  misc_feature: GZ8MTXP02HJ7A7.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgcttattttagaaggtgtccagtgtgaggtgcaggtggtggagtcggtgggggaagtcgttgggtacaggccgttgggacgggttccctggacgtaccttcttcgtggtgcagtcccttgtggtatttcgactttagtagttatagtaaatgaacgtcgggtccgacccgaggcctaccggaggggtaacggcgtagggtagttgggtttacattactatttactaagttattcgtacggtaccccatacctactatcgattacgtctcttaggtacggaccggggccgttactacccacctatccctaaaccgagtaaccgaccgaaaccgacccgaaaggtaacccttaccttaactttacgaccgttaacgaaaccgttaaaagtgggtaacacccggtaacggtaccggttaaccgaaggggtaacggtaacccgggtaaagggttaaccggttacggggtttttaaactttaggttaccgttagggtccggtaacgaaacggttacgttaacgtttaacggttccttaggtttaaccgttaacggttccggggtttacccggtaacccgggtaacgttaaccccgttttaaaaagttcccgg

SEQ ID NO: 392936 - DNA, 707 bp, Homo sapiens
  misc_feature: GZ8MTXP02IQBB3.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgctgggttttccttgttgctatttagaaggtgtccagtgtgaggtgcaggtggtggagtcgtgggggaagcttggtacagccgtgggagggtccctggagtacttcttcgtgtgctacgcctcgtggattcgactttagtagttatagtaaatgtaacgtcgggtaccgccgaggcctacggaggggaacggggtcgtaggtaggttcgggtttacaagttactattttacttaagttaatttcgtacggttaacccctaattaacctaacttaacgtcgtaccgtaagttcctacgttggttaacggaacggggtcccgtaactttaccgaacctagtaccctaccgaaacggtacgaacccgaaacccgtcccgaaaggtaaaccttcaaacctttagtcttagaactaaagtgacgtacacgaccgtagggaacgtggtacggaacggtaacgtaaccgggtttatttacgttacgaggttacgacggtaaaggtacgtaagtcgttaccgtgttaacgttaacgtcggtacccgttacggggacttaaccgttaaacgttacg

SEQ ID NO: 392937 - DNA, 661 bp, Homo sapiens
  misc_feature: GZ8MTXP02F0P3I.11.19.B08.1.454.CMB.2.raw
  modified_base (310)..(310): a, c, t, g, unknown or other
  modified_base (617)..(617): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaggtgtccagtgtgaggtgcaggtggtggagtcgtgggggaagcgttggacagccgtgggacgggtccctgagtacttcttctgtcgcacgtcctcgttggtattcgtacttttagtagttatagaaatgaacgtgggtccncgaggcctacggaggggacgggctagggaggttgggttacagttactattttcgtaagtactttctacggtaccccattaccacttatgacttagtctcgtggtaggaaccgggtccgtaatttcccgaacctagtccttaccgaagaacaacgaaaccgaccgaaggtaaaccttacttacctttaaactccttaggaaacctaaaagtggacgacgaactcccgtaagggagtacgtaacgggacggtaacgtaacggggtttattttaactacgtaggttgacggaagtacgtattacggttancgtttgtacgtcgttacggttaccgagttactaaccgtttaagg

SEQ ID NO: 392938 - DNA, 690 bp, Homo sapiens
  misc_feature: GZ8MTXP02JB4AC.11.19.B08.1.454.CMB.2.raw
  modified_base (212)..(212): a, c, t, g, unknown or other
  modified_base (299)..(299): a, c, t, g, unknown or other
  modified_base (361)..(361): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagccgtggagggtccctgagactcttctgtgcagcctcgtggattcgtacttagtagttatgaaatgaacgtgggtccncaggctccgagggaggctggagtgggttcatcatttctagtattctggtacccatacactancgacagtctctggtacggaaggggacccgtatttaccgaaccctacttcctacccgaaggaacgaacccaaaccgcccgaaaggtaaccctccttaacctttatacctacggaacctaaaagtcggaacggaccgacggtacccgttagggaacggtacggaccgggtaaaggggaaccccgttaaagggggttttaaaacttttaggtttaaccttgggttcggaaccggtaaaggtaaacggtaaagtttaacgggtcctttagggttaacccttaagttccgggtaccggttaccggggtaacgtaacctttaaacggtttaacgg

SEQ ID NO: 392939 - DNA, 851 bp, Homo sapiens
  misc_feature: GZ8MTXP02H0O09.11.19.B08.1.454.CMB.2.raw
  modified_base (212)..(212): a, c, t, g, unknown or other
tcagcgagagataccacgaccggtgctcgatttagtgagtcagtaagggctcagagaggtgccttagccctggattccaaggcatttccacttggtgatcagcactgaacacagaggactcaccatggagttgggctgtgcttggttttccttgttgtcttatttagaaggtgtccagtgtgaggtgcgaggtggtggagtcgtgggggaancgttggtacaggtccgtgggacggttcccagtacgtacttcttcgtggtcgtacgacggtcccttcgtggtactttacgtactttaaggtaagttagtagtaaagtacggtaacgttcggggtccccgaccgacggtacccgtaccgggaaggggtaaacgggggtccgttaggggtacggtttacgggtttacaacgtttaacgtttacgttttacgttaaaaggtttaactttccggttacggtaaaccccctaaatttaaccctaagttacgttacggacccgttaggttccctttacgggttaggtaaaccgggttaaccggggaccccttattaaccctaacccatttacccgaacgaacggaacgtaaacccgaaaccggaccgtaaaacggtacccttaacctttaaccgttttaacgtaccgttaactaaacgtaaacgtacggaaccgtacgtaaccggtacggaggtaaacggtacgggttaaacggttaacggtaaacggtttaacgttttaactttacgttacggtagggtaacggtaacggtaaacggtacgtaacgttacgttacgttaggtaaccgttacggtccggttaccggttaccggtaacttaaccgtttaaacgtacg

SEQ ID NO: 392940 - DNA, 573 bp, Homo sapiens
  misc_feature: GZ8MTXP02FVXZP.11.19.B08.1.454.CMB.2.raw
  modified_base (212)..(212): a, c, t, g, unknown or other
  modified_base (297)..(297): a, c, t, g, unknown or other
  modified_base (315)..(315): a, c, t, g, unknown or other
  modified_base (356)..(356): a, c, t, g, unknown or other
  modified_base (539)..(539): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaancttggtacagcctgggaggtccctgagactcttctgtgcagcctctggattcgactttagtagttatagaatgaactggggtccncaggctcgaggggagggntggagtgggttcatatatttctagtaattcgtggtaacccntacactatgcctagtctctaggtgaacggggccattccacagtcaccagacacaacgtcagaaccttcattatctagacaaatgaacgtcaagtcgagaggactaggacgggtaaccagggtttaatttacgtaccggttgtacggacgaggacggtaagttcgtacgttagtccggtttaancggttaccggtacgggaacttaccgtacgtaacg

SEQ ID NO: 392941 - DNA, 637 bp, Homo sapiens
  misc_feature: GZ8MTXP02GEWAH.11.19.B08.1.454.CMB.2.raw
  modified_base (301)..(301): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctatttagaagtgtccagtgtgaggtgcaggtggtggagtcgtgggggaagcttggtacagccgtgggagggtccctgagactcgttctgtgcagtcctcgtggattcgtactttagtagttatgaaatgaacgtgggtccncaggctcgagggagggcgtggaggtgggttcatactatttctagttatctggtaccccatacatatgcagtctcgtggtggaaacgggtccgtaattccacctactcctacccaagacgaacaacgacccgaacggtaactctaacctttaactcgtacgacaaatcgagtcaagcctaggacgtacggtacggaaggtaccgtaacgggttattttaaacgttacgttaggttaggacggtaaggtaacgtagttaacggttccgttggtttaacccgtaagtttcggtacccgggtttacccggggaacggttacctttaaaacccgtttaagg

SEQ ID NO: 392942 - DNA, 773 bp, Homo sapiens
  misc_feature: GZ8MTXP02HJUI6.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttgggctgtgcttgggttttccttgttgctattttagaaggtgtcagtgtgaggtgcgaggtggtggagtcgtgggggaatcgttggtacagccgtgggacggtccctgagactcttctgtgcagcctgtggattcgtactttagtagttatagtaaatcgtaacgtcgggtccgccgtaggcctacgggaaggggaacggggtcgtagggtaggtttcgggttacaactttaacttagttttacttaaagtttaacttccgttacggtaaccccctaaataacctaacttaagtcgtaccgtaagttccttcggttagggttacggtaaaccgggggtacccttactaccgtaaaccctattacccacccgaaagaaacggtaaacccaacccgaacccgtaaagggtaaacccctttacgtttaaaccctttttaggaacccgttaaacgtaaacgttaaacgtcgtaaccggaccacggtaacgtaagggaacggtaaggtaaccgggaaacggttaacgttaaggttttaactttaacgttacggtagggtagacggtaaagttaagtacgttacgtttcttacgttaacgttacggtcggttaccgggttaccggaactttaaccgtttaaacgtcg

SEQ ID NO: 392943 - DNA, 549 bp, Homo sapiens
  misc_feature: GZ8MTXP02G5UW2.11.19.B08.1.454.CMB.2.raw
  modified_base (173)..(173): a, c, t, g, unknown or other
  modified_base (268)..(268): a, c, t, g, unknown or other
  modified_base (273)..(274): a, c, t, g, unknown or other
  modified_base (284)..(284): a, c, t, g, unknown or other
  modified_base (315)..(315): a, c, t, g, unknown or other
  modified_base (349)..(349): a, c, t, g, unknown or other
  modified_base (351)..(351): a, c, t, g, unknown or other
  modified_base (355)..(355): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgtgctattttagaaggtntccagtgtgaggtgcaggtggtggagtctgggggaacttggacagcctggagggtccctgagactctctgtgcagcctctgattcgattagatanagaannaacgtggtcncagctcagggaaggctgagtcggttcaatanagtttcaagtatctacggaccctatactacagtncngtcngtgtacgacgctactcacatcaccgagacacaaacgtcgaaacgtaacctctacttagtactagaacgaaagtagagacacgacgacgagacgtacgtacgacgtaacgtaagttaactacgtagtagacgagaagtacgtacgtatacgtaacgttacgtacgtacggtaccggtacgtaacgtaacgtaacg

SEQ ID NO: 392944 - DNA, 834 bp, Homo sapiens
  misc_feature: GZ8MTXP02G04O1.11.19.B08.1.454.CMB.2.raw
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaagtcgttggtacagccgtgggacgggtccctgacgacttcttctgtgcacgtcctcgtggtattcgtactttagtagttatagaaatgaacgtcggtccgccgaggccgtaccggaggggaacgggtcgtaggtaggtttcggggtttacaagttacttagtttttaccttaaagtttaacgtttaccgttacgggtaaccccctaagttaacctaacttagtccgtaccgtacggttccttacggttagggtacgggtaaaccgggggcccttaactttacccgaaccctactcccgttaacccaaaggaaccggaaacccaaacccgtacccgtaaacgggtaaaccctttaccttaaacttttacgtaccgtttaagaaacccgtttaaaagtacggaaccgtaccgtaaccgggtacccgtaagggtaacgggtaacggtaccggggtaaaccgggtaaaccggtttaaaccgggggtttttaattttaaacgggttaccgtttagggtacggtacgggtaagggtaaacgtaacgtttacgttacggttacggttaaccgttcggttaccggttacccggggttaccggttaacgtaacccgtttaaacgtttaacgg

SEQ ID NO: 392945 - DNA, 558 bp, Homo sapiens
  misc_feature: GZ8MTXP02IBFSE.11.19.B08.1.454.CMB.2.raw
  modified_base (260)..(260): a, c, t, g, unknown or other
  modified_base (428)..(428): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtcgtgggggaagcttggtacaggcctgggagggtccctgagactcttctgtgcagccctntggattcgactttagtagttatgaaatgaactgggtccgccaggcctcgaggggaagggctggagttgggttcatactattctaagtattcgagtacccatacatatgcagtctgtgagaagggtccattcaccatccacagacgacaacgcaaggaactcaactttnctagactaaatgaagcagcctaggaacgaggtagaacgggtacacggggtttatttaacttacgtggttggactaagggataagtacgttctaggtctaagtcgtcgttaccgggagtacttaaacgtag

SEQ ID NO: 392946 - DNA, 625 bp, Homo sapiens
  misc_feature: GZ8MTXP02FMIX4.11.19.B08.1.454.CMB.2.raw
  modified_base (303)..(303): a, c, t, g, unknown or other
tcagcgagagataccacgaccggtgctcgatttagtgagtcagtaaggggctcagagaggtgccttagccctggattccaaggcatttccacttggtgatcagcactgaacacagagtactcaccatggagttggggctgtgctgggttttccttgttgctattttagaaggtgtccagtgtgaggtgcaggtggtggagtcgtgggggaagcttggtacagccgtgggacgggtccctgagacctcttctgtgcagcctcgtggattcgactttagtagttatagaaatgaactcgggtccnccaggctcgaggggaggggctggagtggttcatacatttctagtatctggtacccatacatatgcagtctactggtaggacggggtcctatttccaaccacttcctacccgtagagaacaaacccgccaaggaaccttacttactttacgtactagaactaaaagtgaacgacaggtaccgtagaggtagtccggaaaggacgtaacggggtttaatttactttacgtacggttaggacgtaagttacgacgttaaggttccttaggtccttaagttcggttacccggtttaccggggaacgttaccgttaaaactttacgg

SEQ ID NO: 392947 - DNA, 601 bp, Homo sapiens
  misc_feature: GZ8MTXP02HGKPA.11.19.B08.1.454.CMB.2.raw
  modified_base (210)..(210): a, c, t, g, unknown or other
  modified_base (263)..(263): a, c, t, g, unknown or other
  modified_base (467)..(467): a, c, t, g, unknown or other
  modified_base (472)..(472): a, c, t, g, unknown or other
  modified_base (480)..(480): a, c, t, g, unknown or other
  modified_base (484)..(484): a, c, t, g, unknown or other
  modified_base (533)..(533): a, c, t, g, unknown or other
  modified_base (540)..(540): a, c, t, g, unknown or other
  modified_base (565)..(565): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaggtgtcagtgtgaggtgcaggtggtggagtcgtgggggaancgttggtacagccgtgggacgggtccctggagtactcttctgtgcagcctcgnggattcgactttagtagtatagtaaatgaacgtcggtccgccgaggcctaccggaggggaaggggctaggagttgggttctagtactagtttctaagttaattcgtagtacccatacatatcgctagtctacgtggtacggaacgggccgtatttccaacctatcctacgagaacgaacaaccgacaggaaacctctactttanactanactaaagngtanacgacgactggtagacgtcggaacgacgtacggttaacttaagttacgngttacgngaaaggtagtatacggttcaggttntaacggtcgtccgttaccgggtacacgtttaacacg

SEQ ID NO: 392948 - DNA, 577 bp, Homo sapiens
  misc_feature: GZ8MTXP02HQ5QG.11.19.B08.1.454.CMB.2.raw
  modified_base (213)..(213): a, c, t, g, unknown or other
  modified_base (251)..(251): a, c, t, g, unknown or other
  modified_base (297)..(297): a, c, t, g, unknown or other
  modified_base (331)..(331): a, c, t, g, unknown or other
tcagcgagagataccacgaccggtgctcgatttagtgagtcagtaaggggctcagagaggtgccttagccctggattccaaggcatttccacttggtgatcagcactgaacacagaggactcaccatggagttggggctgtgcttgggttttccttgttgctattttagaaggtgtccagtgtgaggtgcaggtggtggagtcgtgggggaancttggtacagcctgggagggtccctgagctcttctgtncagcctctggattcgactttagagttatagaaatgaactcgggtcnccaggctcgagggacggggctggtagtgggtttnattactatttcaagtacttcgtcgtaccccatacactatgcagtctgtagtgaacggcatttcactatctccgagacgacaacgcaacgaactacgtaccttagtcctagaccaaattcgaaggtccacggacctaggaagcgtacgggaacggaacttaaccggggttaatttacgttaacgtggttacacgtaagaagtactagtcgtacttaacgagttgtccgtacgggctaacgtactacg

SEQ ID NO: 392949 - DNA, 573 bp, Homo sapiens
  misc_feature: GZ8MTXP01AICRJ.4.26.C04.1.454.CMB.2.raw
  modified_base (460)..(460): a, c, t, g, unknown or other
  modified_base (542)..(542): a, c, t, g, unknown or other
tcagagcactgtagcacgaccggtgctcgatttagtctagcgactttgggtttgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgagggccattcaccatctccagagacaattccaaagaacacgttatatctgacaaatgaacagcctgcgagccgacgacacggccgtatattactgtgacgaaatgccttatgcgacgagcgtagcagtggctggtgcaacgtggcctaccgacccccgtggggcccaacgggaacccatcgtcaccgtctcctcacgcctccaccgaacgggcccagtccggtccttcccccgtggccgccctgcctccgaggcncccgaccctccgaacgaaccaccgacggccggtcccgtcggggcctcggccgttcggtacaacggtacctaccttcccgacncgtcgctcgtggacggcgggcgttgggaacg

SEQ ID NO: 392950 - DNA, 566 bp, Homo sapiens
  misc_feature: GZ8MTXP01B8GYI.4.26.C04.1.454.CMB.2.raw
  modified_base (307)..(307): a, c, t, g, unknown or other
  modified_base (366)..(366): a, c, t, g, unknown or other
  modified_base (389)..(389): a, c, t, g, unknown or other
  modified_base (475)..(475): a, c, t, g, unknown or other
  modified_base (478)..(478): a, c, t, g, unknown or other
  modified_base (563)..(563): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtgtgtttctaggtggctatttaaaggtgtcagtgtgaggtgcagttggtggagtcgtgggggagcgttggtacagccgtggggggtccctgagctctcctgtacagactctggattcacttagcagccatgaccatgacgcgtcgggtcccncgaggcctaccgaagggggaacggggcgtgggaggtgggtcttcgaggctaagttaggnggtagggtggtggtggtagtacngtactacggactaaacgtccgaggacggggaccattccaccatccaccaaggaacacaactacaacaactaactatatacgtatanaanacgacacgcgcgacgacgaccgacgacgcgtaacgtattatacgttagtagtacgttacgttcttctcgtcgcgcgacgcgtcgngtg

SEQ ID NO: 392951 - DNA, 643 bp, Homo sapiens
  misc_feature: GZ8MTXP01BHW6Z.4.26.C04.1.454.CMB.2.raw
tcagagcactgtagcacgaccggtgctcgatttagtctagcgactttgggtttgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccattcaccatctcagagacaattccaaagaacacgttatatctgacaaatgaaacagcctgcgagccgacgacacggccgtatattactgtgacgaaatcgccttatgcgaccgagcgtagcagtggctggtgacaacgtggcctaccggaccccgtgggggacccaacggggaaaccccagtcgtccaccgttcctccctcgacgccctacccaacccgaacgggcccctacgttcccggtcccttcccccgtcggcccgtccctcgccgtacccgacggacgcccgacccgtacccgaacgaaccgaaccgaccggcccgggccccgtggggccttccggcccgttcgggtaccgaaacgggtaacccttacccgttacccgttacgttacggtcgtcctcgtcgggacgggccgggcgttcgggaaccg

SEQ ID NO: 392952 - DNA, 551 bp, Homo sapiens
  misc_feature: GZ8MTXP01DSNF4.4.26.C04.1.454.CMB.2.raw
  modified_base (198)..(198): a, c, t, g, unknown or other
  modified_base (252)..(252): a, c, t, g, unknown or other
  modified_base (294)..(294): a, c, t, g, unknown or other
  modified_base (340)..(340): a, c, t, g, unknown or other
  modified_base (346)..(346): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagngcccggcctccatctcctgcaggtctagtcagagcctcctgcatagtaatgganacaatattggattggtactgcagaagccagggcagtctccanagctcatcattcttagttggtctaacgtccgggctccggggtcccngtaacnggttcagtggcagtggatcgaggcacagtatttacaactagaaaatcagcagagtggagcgtgggaggtagtggttagggtctacttattagttgactagtagaccaagtcttaccttaccgtaaacgttcccgtctcgttaccgtttcggggacgggaacggggaacccgtaagggtacggagttagtaaccgaaacgtaacgg

SEQ ID NO: 392953 - DNA, 546 bp, Homo sapiens
  misc_feature: GZ8MTXP01CTPTE.4.26.C04.1.454.CMB.2.raw
  modified_base (382)..(382): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcctgacatagtaatggaagacaacttattggattggtacctgacaagaagccgagggcagtcctaccacagctcatctattcttagtttggtctaacgtccgggctccggggtcctgaactaggttcagtgcagtggatcgagcanagtattacactagaaatcagcagagtggagcgtgggaggtagttggtgggcttattagttagttgctagtgacaagtcttacgttacgtaacgttcccgtactccgttacggtttcgggacgggaacgggtaccgaagggtcggagactaacgaaacggtaacg

SEQ ID NO: 392954 - DNA, 598 bp, Homo sapiens
  misc_feature: GZ8MTXP01DDHVD.4.26.C04.1.454.CMB.2.raw
  modified_base (253)..(253): a, c, t, g, unknown or other
  modified_base (303)..(303): a, c, t, g, unknown or other
  modified_base (346)..(346): a, c, t, g, unknown or other
  modified_base (361)..(361): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtcctccactctccctgcccgtcacccctggagacgcccggcctccatctcctgcaggtctagtcagagcctctgcatagtaatgganacaacttattggattggtacctgcagaagccagggcagtctccacagctnatcattcttagtttggtactaacgtccgggcctcggggtcccngaacaggttcagtgnagtgatcgagcacagtatttacactaagaaaatcagcaaggagtagggagcgtaggggaggtagtggttagggcttattagtttagttagcgtagtacgacgtaaacggtccttacgttaacgtaaccgttccccggtaccttcccggttaaccggtttccggggaaccggggaacgggggtaaacccggtaagggggttacgggaaggttaaacgttaaccgaaaacgggttaacg

SEQ ID NO: 392955 - DNA, 585 bp, Homo sapiens
  misc_feature: GZ8MTXP01DEAD5.4.26.C04.1.454.CMB.2.raw
  modified_base (186)..(186): a, c, t, g, unknown or other
  modified_base (368)..(368): a, c, t, g, unknown or other
  modified_base (394)..(394): a, c, t, g, unknown or other
  modified_base (442)..(442): a, c, t, g, unknown or other
  modified_base (480)..(480): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtgtcgttttctaggtggctaattttaaaggngtccagtgtgaggtgcagttggtggagtcgtgggggagcttggtacaggccgtggggggtccctgagactctcctgtacagactctggattcacctttagcagccatcgccatgagctcgggtcccgccagggctccggaaggggagggggctgggaggtggggtctcgagcaagttacggnggtagggtggtggtggtacgggtacntactacgactaaacgtccgtggacggggccatcaccatcaccagaaanactaactacaaagaactagttatatacgtagaactaanaagacacgcgcgacgacgaccgacgacgacgtaacgtattacttacttgtagtacgttaacgttcgttacgttaacgtacgccgacggacgttacgtaacgcgtg

SEQ ID NO: 392956 - DNA, 549 bp, Homo sapiens
  misc_feature: GZ8MTXP01ATP35.4.26.C04.1.454.CMB.2.raw
  modified_base (252)..(252): a, c, t, g, unknown or other
  modified_base (302)..(302): a, c, t, g, unknown or other
  modified_base (353)..(353): a, c, t, g, unknown or other
  modified_base (442)..(442): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagagccctcctgcatagtaatgganacaactatttggattggtacctgcaagaagccgaggggcagtcctaccanagctcatcattcttagtttggtctacgtcgggcctccggggtccctgaacnggttcagtggacaggtgatcgagcacagtatttacactagaaaatcagcgaagagtgggagtcgtaggggaggtagttggtgggtcttnttagttagttgctagtgacaagtctacttacgaacgttcccggtactcgttaccggttcgggacgggaacgggaaccgaagggtggagttacgtaacgaaacgtaag

SEQ ID NO: 392957 - DNA, 628 bp, Homo sapiens
  misc_feature: GZ8MTXP01DEE24.4.26.C04.1.454.CMB.2.raw
  modified_base (302)..(302): a, c, t, g, unknown or other
  modified_base (488)..(488): a, c, t, g, unknown or other
tcagagcactgtagcacgaccggtgctcgatttagtctagcgacttttgggtttgggggtccctgagactctcctgtacagactctggattcacctttagcagccatgccatgagctgggtccgccaggctccagggaagggctggagtgggtctcagcaattagtggaggtggtggtggtggtacatactacgcaaactccgtgaggggccattcacatctcagagacaattccaaagaacacgttatatctgacaaatgaacagcctgcgagccgaacgaacaaggccgtaatattaacngtagacgaaaatcgtacctttaattgaccgaaccggaagcgttagctaggtcggacttcgggtagcaaacgtcggcctacccgggaaccccgtgggggacccaaacggggaaacccctagtcgtaccacccgttcctccctcacgccctaccaaccgaacgggccctagtccggtcccttccccgngccgccctcgccgtccgaggacgccaaccgtccgaacgaaaccacgacgccggccctggggcctcggcccttggtaccaaaggtaccttacttccccttaagcgttcgcttcgaggacgttccgggaacgttcgggaacg

SEQ ID NO: 392958 - DNA, 529 bp, Homo sapiens
  misc_feature: GZ8MTXP01DVP6Q.4.26.C04.1.454.CMB.2.raw
  modified_base (252)..(252): a, c, t, g, unknown or other
  modified_base (384)..(384): a, c, t, g, unknown or other
  modified_base (411)..(411): a, c, t, g, unknown or other
  modified_base (447)..(447): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtgggatattgtgatgactcagtctccactcctccctgcccgtcaccctggagacgcccggcctccatctcctgcaggtctagtcagagcctcctgcatagtaatgganacaactattggattggtacctgcagaagccagggcagtcaccacagctcatcattctatttgggtactaacgtccgggctccggggtcctgaacaggttcagtggcagtggatcgaggacactagtatttanactagaaaatcagcgagagtaggaggngtaggggaggtagttggttgggcttgtattattcgntatgacaagtctacttactacggttccctcgtcttcgttcgggacgggtaacggacgaagggtggagactaacgaacgtaag

SEQ ID NO: 392959 - DNA, 564 bp, Homo sapiens
  misc_feature: GZ8MTXP01CDURT.4.26.C04.1.454.CMB.2.raw
  modified_base (295)..(295): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactattggattggtacctgcagaagccagggcagtctccanagctcatcatcttagtttgggtctaacgtccgggcctccggggtccctgaacaggttcagtggcagtgatcgagcacagtatttaacactagaaaatcagacagagtggaggcgtaggggaggtagttggtgggtcttcgttagttagttgacgtaattgacgaaagtcctacttaacgtaacgttcccggtacttcgttaaccggtttccgggacggggtaacggggtaacccgaagggtaggagttacgtaaccgaaacggtaacgg

SEQ ID NO: 392960 - DNA, 512 bp, Homo sapiens
  misc_feature: GZ8MTXP01ED3TF.4.26.C04.1.454.CMB.2.raw
  modified_base (253)..(253): a, c, t, g, unknown or other
  modified_base (400)..(400): a, c, t, g, unknown or other
  modified_base (428)..(428): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtggggatattgtgatgactcagtctccactctccctgcccgtcacccctggagacgccggcctccatctcctgcaggtctagtcagagcctcctgcatagtaatgganacaatattggattggtacctgcagagccagggcagtctcacagctcatcattctagtttggtactaacgtcgggcctccggggtccctgaactgtcagtggcagtgatcgagcacgagtatttacaactagaaaatcgagcgagagngggagcgtgggaaggtgtggtggtcttntattagtgctatgcaagctacacaacgttcccgctcttacgttcggacgggaaggaacgaaggtggagataacgaaacgtaacg

SEQ ID NO: 392961 - DNA, 698 bp, Homo sapiens
  misc_feature: GZ8MTXP01DC6F8.4.26.C04.1.454.CMB.2.raw
tcagagcactgtagcacgaccggtgctcgatttagtctagcgactttgggtttggggtgatcaggactcctcagttcaccttctcacaatgaggctccctgctcagctccgtggggctgctaatgctcgtgggtctctggatccgaggtggggatattgtgatgactcagtctccactcctccctcgcccgtccacccgtggagacgccgcctccatcctcctgctaggtctagtcagacgcccttccgtgacaagttaaggtaagtgggaaataacctaattagtttggactttacgggtacctgacgaagaacgccggaagggctacgtcctaccaacgcgtctacaatcctatttcgttaaggtttcgggtacctaaaccggtcccggggtccgttcccgggggtccctaggaaaccgttagggttcgagggttcgggaccgtagggtcgggttaacacgaacggacctaagtaacgtttaaacgtttaaccaacgttaaaggaaaacttacgaaggacgaaggaggtagggaagggtgtaagggggtaggttaaggttgggtttcgggtactttagttaagtttagttacgactaagcgtacaaacgtcctaacttaacgtaccgttcccgtacgtcgttacggttcgggacgggaaggaacgtaagggtaggattacgtaacgaaacgtaacg

SEQ ID NO: 392962 - DNA, 594 bp, Homo sapiens
  misc_feature: GZ8MTXP01B4WIO.4.26.C04.1.454.CMB.2.raw
tcagagcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaaagaacacgttatatctgacaaatgaacagcctgcgagccgacgacacggccgtatattactgtgcgaaatgccttattgcgaccgagcgtagcagtgctggtgcaacgtggctccggacccctggggccaggggaacccatcgtcaccgtctccctcacgccctaccaccgaacgggccccagttcccggtccttcccccgtggcccgtcccctgcctccgaggacgccaccctccgaacgaaccaccgacgcccggcccgtggggccttcggccgttcgggtaccaaacgggtaccttacccttcccttaaccgcggtcgccttcgcgggcggccgggcgttcggggaaccg

SEQ ID NO: 392963 - DNA, 632 bp, Homo sapiens
  misc_feature: GZ8MTXP01CJK7K.4.26.C04.1.454.CMB.2.raw
  modified_base (248)..(248): a, c, t, g, unknown or other
  modified_base (297)..(297): a, c, t, g, unknown or other
  modified_base (304)..(304): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtggggatattgtgatgactcagtctccactctccctgcccgtcaccctggagacgccgctcatctcctgcaggtctagtcagcgcctctgcatagtaatgganacaactagttggattcggacctgacagaacgcgagggcagtcaccgaancgtctanatctattacgttagtttcggtactaccggtccggtccgtccgggtctaggtaacgtaggtcgtaggtcgacgtaggtgactacgacgtacacgtagtaacttacgaagtaagaacgtacgagacgaggtagtaggaggtagtaggggtaggtaggttaggttacggtacgttacgttagttagttagtacgtacgtacgtacgtaacgtaaccgtaaccgttaaccgtaccgttacccgtaccgtaccggttaccgggttccgggttaccgggtaacgggtaacggtaacgggtacggtaacggttaacgtaacgttaaacggtaacg

SEQ ID NO: 392964 - DNA, 655 bp, Homo sapiens
  misc_feature: GZ8MTXP01EHNJE.4.26.C04.1.454.CMB.2.raw
  modified_base (434)..(434): a, c, t, g, unknown or other
tcagagcactgtagcacgaccggtgctcgatttagtctagcgacttttgggtttgggggggtccctgagactctcctgtacagactctggattcacctttagcagccatgccatgagctgggtccgccaggctccgagggaaggggctggagtgggtctcagcaattagtggaggtggtggtggtggtacatactacgcaaactccgtgagggcattcacatctcagagacaattaccaaagaactacgttatatctgacaaatgaacagcctgcgacgccgaacgaacaacggccgtaatattactgtagactaaatcgtacctttagttcgacgacccgagcgtagcgaggtggctggtcgactaacgtcggccctaacccggaccccgtgggggacccaacggggaaccctagtcgtccaccgtcctcccnctacgccctaccgaaccgacgggcccctacgttcccgtcccttccccgcggccctccgtcgccgtaccgacggtaccgacccaccgtaccgacgaaccgtaccgacgcccgggtcccgtcgggccgtcggccgttcgggtaaccgttaaacggtacctttaacccgttacccgttacgacggtcctcgtaacggacgggccggttcgtcggaacgaacggg

SEQ ID NO: 392965 - DNA, 612 bp, Homo sapiens
  misc_feature: GZ8MTXP01BQ3F6.4.26.C04.1.454.CMB.2.raw
  modified_base (259)..(259): a, c, t, g, unknown or other
  modified_base (264)..(264): a, c, t, g, unknown or other
  modified_base (274)..(274): a, c, t, g, unknown or other
  modified_base (295)..(295): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtgggatattgtgatgactcagtcctccactcctccctgcccgtcacccctggacgacgcccggcctccatcctcctgctaggtctagtcagacgcctctgacatagtaatgganacatnttgatgtacngcagagccaggcagtctccanagtctacatcattcttagtttcggttactaccggtccgggtaccgttcccggggtcctaggtaacgtaggttcgagggtcgactaggtggtactcgacgtactaacgtaaggttactttaacgtactaaagtaaactcgagacgaaggagtagggtagacgtaggggaggtaggttgggtacggtactgttaattgttgactagtcgaagtacaacttcgttaaaccgtaccggttccctcttcgttaccggttcggggacgggtaacggggtaccgaagggttacggaacgttacgtaaccgttaaacggtaacgg

SEQ ID NO: 392966 - DNA, 806 bp, Homo sapiens
  misc_feature: GZ8MTXP01B8D48.4.26.C04.1.454.CMB.2.raw
  modified_base (262)..(262): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtggggattattgtgatgactcagtctccactcctccctcgcccgtccaccccgtggagacgccggcctccatctcctgcaggtctagtcagacgcctctgacataagtaagtggaanaactaacttagtttggattcggtacctgacgagaacgccgagggctagtccctaccacacgctacatctattcgtttagtttcgggttacctaacggtccgggtcccgttccgggggtacccctaggtaaaccgttacgggtttcgacgggttcgggaccgtagggtcgggtacgtaccgaacggggtacctaacgtaacgtttaacgttttaacaaacgttaaacggtaaaaaacgttccgaaaggacgtaaagggtaaggggtacggggtaagggtaccgggttaaggggggtaacggggtttaacgggtttggggtttacgggttaccgttttagtttaaacgttttaggtttacgtacggtaacgttacggtaaccgtaaacggtaacccctttaacggttaaaccgtaaaccccgggtttaccccgtacggtttacccggttaaccggggtttccgggggaacgggggtaaaccgggggaaccggtaaagggggtacggtaacggttaaacgttaaacccggttaaacgggttaacggg

SEQ ID NO: 392967 - DNA, 666 bp, Homo sapiens
  misc_feature: GZ8MTXP02JMG53.4.26.C04.1.454.CMB.2.raw
  modified_base (157)..(157): a, c, t, g, unknown or other
  modified_base (211)..(211): a, c, t, g, unknown or other
  modified_base (301)..(301): a, c, t, g, unknown or other
tcagagcactgtagcacgaccggtgctcgatttagtctagcgactttgggtttgggagctctgagagaggagcccagccctgggattttcaggtgttttcatttggtgatcaggactgaacagagagaactcaccatggagtttgggctgagcgtgngtttctaggtggctatttaaaaggtgtccagtgtgaggtgcagttggtggagtntgggggaggcttggtacagcctggggggtccctgagctctcctgtacagctctggatcaccttagcagccatgccatgagctggtcgccnggctccaggaaggggcgtggggtaggtggtcgtcgagtacgtaagtacggtaggtagggtgggtggtggtaggtacgtacgtacgtacgtaccgtaaccgtaccgtacggacgggtaccggtacgtaccgtacctactacgtaccgaacgacgaactaactaaccgtaaacgtaaacgtaacgttaacgttacttacgtacgtaacgtaaacgtaacgtaaacgtaacgtaccgtacgacggaccggaccggaaccgaccgaaccggtaccgttacgttaacgttaacgttacgtacgtacgtaaacgtacgttaccgttaacgttacggtaccggtaccggacggtacggtacggtacgtacgg

SEQ ID NO: 392968 - DNA, 529 bp, Homo sapiens
  misc_feature: GZ8MTXP02I4379.4.26.C04.1.454.CMB.2.raw
  modified_base (344)..(344): a, c, t, g, unknown or other
  modified_base (364)..(364): a, c, t, g, unknown or other
  modified_base (405)..(405): a, c, t, g, unknown or other
  modified_base (410)..(410): a, c, t, g, unknown or other
  modified_base (436)..(436): a, c, t, g, unknown or other
  modified_base (439)..(439): a, c, t, g, unknown or other
  modified_base (441)..(441): a, c, t, g, unknown or other
  modified_base (446)..(446): a, c, t, g, unknown or other
  modified_base (448)..(448): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtgcgtttctaggtggctatttaaaaggtgtccagtgtgaggtgcagttggtggagtctgggggagcttggtacagcctgggggtccctgagactctcctgtacagactctggattcaccttagcagccatgccatgagctggtccgccaggctccagggaaggggctgggagtgggtctcagcattagnggagtggtggtggtggtacngtactacggcaaacgtccgtagaggggccgattcaccatcncaganacaactacaagactactatatcaganaananacacncncgcgacgacgacgacgacgacgtactactacgtagtacgtacgaacgtacgtactaacgtcgacgacgacgcgacgacgcg

SEQ ID NO: 392969 - DNA, 549 bp, Homo sapiens
  misc_feature: GZ8MTXP02H9266.4.26.C04.1.454.CMB.2.raw
  modified_base (291)..(291): a, c, t, g, unknown or other
  modified_base (295)..(295): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtatggagacaactatttggattggtacctgcagaagccagggcagtcnccanagctcatcatcttatttgggtctaacgtcgggtcccgtccggggtcctgactggttcaggtggcagtgatcaggcacagtatttacactagaaaatcagacagagtaggaggcgtaggaggtagttggttcgggtacgttacgttagtttaagttggtctaagtgactaaagtctacgtacaacgtcccgtactacgtaccgtttcggacgggtaacgggacgaacgggtaggaagtacgtaacgtaaacgacg

SEQ ID NO: 392970 - DNA, 515 bp, Homo sapiens
  misc_feature: GZ8MTXP02H6D6L.4.26.C04.1.454.CMB.2.raw
  modified_base (294)..(294): a, c, t, g, unknown or other
tcagagcactgtagcacgaccggtgctcgatttagtctagcgactttgggttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccanagctcatcatctatttgggtctaagtcgggcctccggggcctgacaggttcagtgcagtgatcagcacagtatttacactagaaaatcagacagagtgggagcgtaggaggtatggtgggcttactattattgctatgacaagtctacttacaaacgtccccgtctaccgtaccgtttcggacggaacgggaccgaagggtggaggactacgaaaacgacg

SEQ ID NO: 392971 - DNA, 590 bp, Homo sapiens
  misc_feature: GZ8MTXP02I6HZS.4.26.C04.1.454.CMB.2.raw
  modified_base (353)..(353): a, c, t, g, unknown or other
  modified_base (376)..(376): a, c, t, g, unknown or other
  modified_base (484)..(484): a, c, t, g, unknown or other
tcagagcactgtagcacgaccggtgctcgatttagtctagcgactttgggtttggggagctctgagagaggagcccagccctgggattttcaggtgttttcatttggtgatcaagactgaacagagagaactcaccatggagtttgggctgagcgtggtcttttctgtggctattttaaaaggtgtccagtgtgaggtgcagttggtggagtcgtgggggaggcttggtacagccgtgggggtccctgagactctcctgtacagactctggattcacctttagcagccatgccatgagctgggtccgccaggctccgaggggaaggggctgggagtgggtctcagcaattagnggagggtggtggtggtcggtacngtactacgacaaaccgtccggtaggacggggcccattccacccattccaccaggacactaaattacccaaagaacctacgtttaatactctagacaaaatcgaaaacncgctaggacgacgacccgaacgaccgtaccggtacgtaattacttacgtacgtacgaacgtaaacgttcgtaccttaagtcgaccgacggacgcgtacgacgtacg

SEQ ID NO: 392972 - DNA, 525 bp, Homo sapiens
  misc_feature: GZ8MTXP02JO9EG.4.26.C04.1.454.CMB.2.raw
  modified_base (251)..(251): a, c, t, g, unknown or other
  modified_base (289)..(289): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatgganacaatattggattggacctgcagaagccagggcagtcnccacagctcatcatctagtttggttactaacgtccggggcctccggggtcctgactaggttcagtggcagtgatcgagcacagtatttacactagaaatcagcagagtggagcgtagaggtagtgggttgggtactagttattagttgacgattagacaagtctactacaacgttcccactccgtacgttcggacggaacggacgtaacgggtacggagacgtacgaaacgtaacg

SEQ ID NO: 392973 - DNA, 537 bp, Homo sapiens
  misc_feature: GZ8MTXP02IP2LM.4.26.C04.1.454.CMB.2.raw
  modified_base (296)..(296): a, c, t, g, unknown or other
  modified_base (429)..(429): a, c, t, g, unknown or other
  modified_base (434)..(434): a, c, t, g, unknown or other
  modified_base (477)..(477): a, c, t, g, unknown or other
  modified_base (512)..(512): a, c, t, g, unknown or other
tcagagcactgtagcacgaccggtgctcgatttagtctagcgactttgggtttggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgagggccgattcacatctccagagacaattccaagaacacgttatatctgcaaatgaacagcctgcgagccgacgacacggccgtatattacngtgcgaaatgccttattgcgaccgagcgtagcagtggctggtgcaactgctcgacccctggggccagggacccagtcgtcaccgtctccctcacgccctccgaccaaacgggcccagtcggtccttcccccgnggccnccctgcctcccgaggacgcacctcgacgaacacagccggccgngggctcgccctggtcaaaggctaccgtttcccaancgtcgctctgacgcgggctgggacc

SEQ ID NO: 392974 - DNA, 508 bp, Homo sapiens
  misc_feature: GZ8MTXP02FKC04.4.26.C04.1.454.CMB.2.raw
  modified_base (428)..(428): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactattggattggtacctgcagaagccagggcagtctccacagctcatcatctatttgggttctaacgtcgggcctcggggtcctgacaggttcagtgcagtgatcgaggcacagtatttacactagaaaatcagcagagtggaggctaggaggatgttgggctctattattgnatgacagactactacaacgtaccgtacctctacgttcggtacggaacgggacgaacggtacggagagtacgaacgaaacg

SEQ ID NO: 392975 - DNA, 575 bp, Homo sapiens
  misc_feature: GZ8MTXP02JIE4H.4.26.C04.1.454.CMB.2.raw
  modified_base (297)..(297): a, c, t, g, unknown or other
  modified_base (405)..(405): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcctgcatagtaatggagactaactattggattggtacctgcagaagccagggcagtctccanagctcatcatctagtttggtctaacgtcgggcctccggggtcctgactaggttcaggtgcagtgatgagcacagtattacactagaaaatcagacgagaggtggaggngtaggaggtagtggtaggtacttagttattagtgacgtagtacgacgaagtactaccgtaaacgtaaccgtcccgtaccgttaccgtaccggtttaccggggaacggggtaacggggtaaaccggtaacggggtacgggtaacgtaaacgtaaaccgtaaaacggtaacg

SEQ ID NO: 392976 - DNA, 599 bp, Homo sapiens
  misc_feature: GZ8MTXP02JQFB3.4.26.C04.1.454.CMB.2.raw
tcagagcactgtagcacgaccggtgctcgatttagtctagcgactttgggtttggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttatgcgaccgagcgtagcagtggctggtgcaactggctcgaccccgtggggccaggggacccagtcgtcaccgtctcctcacgccctccaccaaacgggccccagtccggttcccttcccccgtcggcccgtccccttgcctcccgaggacgccaccgtccgacgaaccacgacgccggccctggggccttcggcccgtgggtaccaaacgggtaccttaccgttacccccgttaacacggttcgcccgttccgttacggacggtcccgggggacgtcgggaacccgg

SEQ ID NO: 392977 - DNA, 595 bp, Homo sapiens
  misc_feature: GZ8MTXP02JMGN5.4.26.C04.1.454.CMB.2.raw
  modified_base (583)..(583): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtgtcttttctgtggctattttaaaggtgtccagtgtgaggtgcagttggtggagtcgtgggggaggcttggtacagccgtggggggtccctgagactctcctgtacagactctggattcacctttagcagccatgccatgagcgtcgggtccgccgaggcctccgaggggaacggggcgtgggaggtgggtctcgagctaagttaggtgggaggtggtggtggtaggtacagtaccgtacgacaaacgtccggtaggacggggccgtaattcgaaccctatccgtccaaagacgaaccaaacttacccgaaaagtaaacctacgtttaaatactctagaacaaaagtcgaaacacgcctgacgacgaccgacgacgacggtacgtattataccgtgtacgacgtaatcgactttaagtcgacgaccgngacgtagctagg

SEQ ID NO: 392978 - DNA, 755 bp, Homo sapiens
  misc_feature: GZ8MTXP02IRCBJ.4.26.C04.1.454.CMB.2.raw
  modified_base (232)..(232): a, c, t, g, unknown or other
  modified_base (263)..(263): a, c, t, g, unknown or other
  modified_base (277)..(277): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtggtcgttttctaggtggctaatttaaaaggtgtccagtgtgagtgcagttggtggagtctgggggagcttggtacngcgtggggtcctgagctctctgtacagactntgtattctacttancagcatcgcatgagtcgtcggtccgcgacggccgtaccggaggggaacgggcggtagggtacgggttcgggtccgtacgagacgtaaggttagggtaggggtagggttggggttggggttagggttaggttaacgtagttaaccgtaaccggaaccgtaaaccgttccgggtacggggacgggggtaccgtacgttaccaacctactaccgtaccgaacgtaaacgtaacctaaacgttaacccgaaaacgtaaaaccgtaacgtttaaattaacgttacgtaacgtaacgtaaacgtaacgaaaccgtaaccgaccgtacggacggaaccggacccggaacccggaacccgtaacccgggtaaccggttaaacgttaaacgttaacgttacggttacgtaacgtaaaacgttaacgttaccgtttaacgttacggtaaccggtaaccggtaacggtaccggtaacggtacggtacgg

SEQ ID NO: 392979 - DNA, 575 bp, Homo sapiens
  misc_feature: GZ8MTXP02JBCFJ.4.26.C04.1.454.CMB.2.raw
  modified_base (325)..(325): a, c, t, g, unknown or other
  modified_base (343)..(343): a, c, t, g, unknown or other
  modified_base (432)..(432): a, c, t, g, unknown or other
  modified_base (437)..(437): a, c, t, g, unknown or other
tcagagcactgtagcacgaccggtgctcgatttagtctagcgactttgggtttgggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccattcaccatctccagagacaattccaaagaacacgttatatctgcaaatgaacagcctgcgagccgacgacacggccgtatattactgtgcgaaatgccttattgcgacccgngcgtagcagtggctggtncaactgctcgaccctgggggccaggggaacccatgtcaccgtctcctcacgccctccaccaacgggcccacgtccggtccttcccccgnggccncccctggcctcccgaggacgccacccgtccgaagaaccacgacgccgcccgtgggcctcggccctgggtaccaaacgggtaccttaccgttaccccaccgtagttcgccttcgtcggacggccgggtctcgggaaccg

SEQ ID NO: 392980 - DNA, 569 bp, Homo sapiens
  misc_feature: GZ8MTXP02GA2J5.4.26.C04.1.454.CMB.2.raw
  modified_base (254)..(254): a, c, t, g, unknown or other
  modified_base (297)..(297): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatcctcctgcaggtctagtcagacgcctcctgcatagtaatgganacaatattggattggtacctgcagagccagggcagtctccacngctcatcatctagtttgggttactaagtccgggcctccggggtccctgaccaggttcagtgcagtgatcgaggcacagtatttacactagaaaatcagcagagtggaagcgtgaggtatgggttgggccttagttattattggactagtagacgtaacgtcttactaacgtaaaccgtcccggtccttaccgtaaccggtttccgggaccggggtaacggggaaacccgaacggggttacggaagtaacgttaacgaaaacggttaaaccgg

SEQ ID NO: 392981 - DNA, 646 bp, Homo sapiens
  misc_feature: GZ8MTXP02FXD9J.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtcgtgggggagcttggtacagccgtgggggtccctgagactctcctgtacagactctggattcacctttagcagccatgccatgagctgggtccgccaggctccgaggggaagggctgggagtggggtctcgagctaagttaggtgggagggtgggtgggttgggtggtaacagtacctacgacaaaccgtccggtaggacgggggccctagttccacctagtcctaccgaagacgacctaaattacccaaagaaacctaacgtttaactaacttcctaagaacctaaaagtacgaaacaaccgccgttaggaccgaacggcccgaaccgacgaaccggtacccgttaaattacgttactggttacgacgtaaaacgttcgacccgttaagttcggaccgttaaaccggacgttaccggtaagccgttaacgggg

SEQ ID NO: 392982 - DNA, 579 bp, Homo sapiens
  misc_feature: GZ8MTXP02GIUM0.4.26.C04.1.454.CMB.2.raw
  modified_base (343)..(343): a, c, t, g, unknown or other
  modified_base (448)..(448): a, c, t, g, unknown or other
  modified_base (469)..(469): a, c, t, g, unknown or other
tcagagcactgtagcacgaccggtgctcgatttagtctagcgactttgggtttgggggtccctgagactctcctgtacagactctggattcacctttagcagccatgccatgagctgggtccgccaggctccgagggaaggggctggagtgggtctcagcaattagtggaggtggtggtggtggtacatactacgcaaactccgtgagggccattcaccatctccagagacaattccaaagaacacgttatatctgacaaatgaacagcctgcgagccgacgacaaggccgtatattactgtgacgaaatgccttatgcgaccgagcgtagcagtggctggtncaatggcctccgaccccgtgggggccaaggggaacccagtcgtcacccgtctccctcacgccctaccaaccgaacgggtccccacgttccggtcccttcccccgngccgccctgcctccgaggacnccaccctccgagaacacgacgccggcctgggcctcggcccgttaggacaaacggtaccttaccttacccacgacggcttccggacggacggcgggtcgacggacgaacgg

SEQ ID NO: 392983 - DNA, 579 bp, Homo sapiens
  misc_feature: GZ8MTXP02INOI7.4.26.C04.1.454.CMB.2.raw
  modified_base (250)..(250): a, c, t, g, unknown or other
  modified_base (254)..(254): a, c, t, g, unknown or other
  modified_base (260)..(260): a, c, t, g, unknown or other
  modified_base (272)..(272): a, c, t, g, unknown or other
  modified_base (295)..(295): a, c, t, g, unknown or other
  modified_base (372)..(372): a, c, t, g, unknown or other
  modified_base (400)..(400): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcctgcaggtctagtcagacgcctctgcatagtaangganacaatnttggattggacngcagagccagggcagtcctacanagctacatcatcttagtttcgggttactaacgtccggggtccgtccggggtcctgacgtaggtcaggtgacagtgancgagacacagtatttacactaagaaatnagacgagaggtggaaggcgtaggaaggtagttggttgggtacttagttagtttagttgctagttacgacaacgtctacgtaaccgaaccgtcccgtaccgttaccgtaccggtttaccgggacggggtaacgggaaccggtaagggtacggaacgtaacgtaacgtaaaacggtaacgg

SEQ ID NO: 392984 - DNA, 750 bp, Homo sapiens
  misc_feature: GZ8MTXP02HROTO.4.26.C04.1.454.CMB.2.raw
  modified_base (276)..(276): a, c, t, g, unknown or other
tcagagcactgtagcacgaccggtgctcgatttagtctagcgactttgggtttggggagctctgagagaggagcccagccctgggattttcaggttgttttcatttggtgatcaggactgaacagagagaactcaccatggagtttgggctgagctggtctttttcttgtggtcttaattttaaaaggtgtccagtgtgaggtgcagttggtggagtcgtgggggaggcttggtacaggtccgtgggggtccctgacgactctcctgtacagactntggattccaccttagcagccatcgccatgacgtcgtcgggtcccgccgaggcctaccggaggggaacggggtcgtgggtaggtcggggtctacgaggactaaaggtttagggtaggggtagggttggggtggggttggggttacggtaactagttaacccgtaacggacctaaaacccggttcccgggtaggggaccgggggtacccgtaactttacccgaaccctacgttacccgtaccaaacggaaacgtaacttaaaaccttacccgaaaaagtaaacccttaaaggtttaaacttacgttccttaaggaaacctaaaagtacggaaaccacggtacccagggaaccgcgggaacccgaaccggaaccgacccgggtaaccttatttaacgtacgttggtacgtaacgaaaacgtttcgacctttaacgtcggaacccgtaccgggtaacgtcggtaaccgtcggtaacgg

SEQ ID NO: 392985 - DNA, 650 bp, Homo sapiens
  misc_feature: GZ8MTXP02HL4C8.4.26.C04.1.454.CMB.2.raw
tcagagcactgtagcacgaccggtgctcgatttagtctagcgactttgggtttggggagctctgagagaagagcccagccctgggattttcaggtgttttcatttggtgatcaggactgaacagagagaactcaccatggagtttgggctgagctggcttttcttgtggctattttaaaaggtgtccagtgtgaggtgcagttggtggagtctgggggaggcttggtacaggccgtggggggtccctgagactctcctgtacagactctggattcaccttagcagccatgccatgagctgggtccgcaggctccgaggggaaggggctgggaggtgggtctcgagctaattagtgggaggtggtgggtggtaggtacagtaacgtaaagctaaaacgtccggtaggacggggccgattcacccatcctaccaagacgactaaacttaccgaaagaaactaacgttaatattactagtaacaaaagtacgaaacacgtaccgtacggaccgacggaccccggaaccgaaccgtaacccgggtacccgttaagttaacgtttaacgtcggtaacgaccgtaaaacgttccgtaccgtttaaacgtttcggacccggtaaccggacggtacggttaaacgaccggttaacggg

SEQ ID NO: 392986 - DNA, 680 bp, Homo sapiens
  misc_feature: GZ8MTXP02IUE2G.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtcttttctgtggcttaatttaaaggtgtccagtgtgaggtgcagttggtggagtcgtgggggaggcttggtacagccgtggggggtccctgagactctcctgtacagactctggattcaccttagcagccatgccatgagcgtcgggtccgccgaggcctcccgaggggaaggggctgggaggtgggtctcgagcaagttagtgggaggtggtgggtggtggtacattacgtacgacaaaccgtccggtaggacgggggtccgaattccgaacccatccctaccgaaagtaacgacctaaacgttacccgaaaagtaaacctacgtttaataacgttctaggtaacaaaagtaggaaaccaacggccgtaacggccgggaaacgggaccccgaaacgggaacccgaaccgggtaacccgttaaagtttaaactttaccgtaggttaccggaacgttaaaaacgttcggttaacccttaagttaccggaccggtaaacccggagtaccggtaaggccgtaaggg

SEQ ID NO: 392987 - DNA, 650 bp, Homo sapiens
  misc_feature: GZ8MTXP02GKBVU.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttggtggagtcgtgggggaggcttggtacgagccgtggggggtccctgagactctcctgtacagactctggtattcacctttagcacgccatcgccatgagcgtcgggtccgccgacggccgtccgaaggggaacggggcgtaggggaggtcggggttctacgagacgtaaagttaggtggggagggtgggtggggttgggtaggtacagtaccaacgacctaaacgtccgtggaaggacgaccgtattccgactatcctaccagaacgtacaaacttaccaaaagtaactacgtttaatatactagactaaagtacgaaacacgcccgtaggaccgacggacccgaacgaaccgaccgggtaccttaattaacgttacgtggtacgaacgtaaaagttcgtaaccctttagttcggacccggaacgtacggtacggtacgacgg

SEQ ID NO: 392988 - DNA, 585 bp, Homo sapiens
  misc_feature: GZ8MTXP02FG1LE.4.26.C04.1.454.CMB.2.raw
  modified_base (375)..(375): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtgcgttttctgtggctattttaaaaggtgtccagtgtgaggtgcagttggtggagtctgggggaggcttggtacagccgtggggggtccctgagactctcctgtacagactctggattcacctttagcagccatgccatgagctggtccgccaggctccgagggaaggggctgggagtggggtctcgagctaattaggtggaggtggtggtggtggtacntacgtacgcaaacgtccgtaggaggggcgacttcgaccatctaccagacgactaattacccaaagaaacacgtttaatactactagacaaaagtagaaacacgaccgtagaccgagacccgaacgacgaaccgggtaccgtaattacttaaccgtgtagaccggtaaaatcggtaccttaagttcgaccgaccggagtcgtaacgcgcgg

SEQ ID NO: 392989 - DNA, 604 bp, Homo sapiens
  misc_feature: GZ8MTXP02GLUWX.4.26.C04.1.454.CMB.2.raw
  modified_base (446)..(446): a, c, t, g, unknown or other
  modified_base (485)..(485): a, c, t, g, unknown or other
  modified_base (504)..(504): a, c, t, g, unknown or other
  modified_base (597)..(597): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtctttttcttgtggctaattttaaaaggtgtccagtgtgaggtgcagttggtggagtcgtgggggaggcttggtacagccgtggggggtccctgagctctcctgtacagactctggtattcctacctttagcacgccatcgaccatgagcgtcgggtcccgccgaggcctaccggaaggggaggggctgggaggtgggtctcgagactaagttggtgggagggtgggtgggtggtaggtactagtacctacgacaaaccgttccggagggacggggacctattccactntcctaccaagacactaattacccaaagtaactacgttanatctagacaaatcgaaacncgcagacgacgccgacgacgtacggtactatacgtacgtgacgaacgtaacttcgtaccttaagtccggaccggtacgacggtacggggtacncggtagg

SEQ ID NO: 392990 - DNA, 687 bp, Homo sapiens
  misc_feature: GZ8MTXP02JT5NK.4.26.C04.1.454.CMB.2.raw
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctcgcccgtccaccccgtggagacgcccggcctccactcctcctgcgaggtctagtcagacgccctctgctatagtaagtggagaactaacttagttggtagttcggtacctgacaagaacgccgaggggctacgtcctaccaacgagtcctactactactagttcctttaaggttttcggggttaacttaacggggtcccggtccggtcccgggtccttgacgttggttcagggtcggactggtaggactacgaggacctaacgaagtttactttaacacgtaaagaaactcgaacgacgaaggacggttagggacggtcgttaggggaagggtagtttgggttacgggtactttacgttagtttaagttcggacttaagtcgaacgtaacgtaccttaaccgtaacgtaacccggttccccgtacgtaccgttaccggtttaccggggacgggggttaaccggaaaccgtaaggggtacggaaacgtacgtaaacgaaaacggtcgg

SEQ ID NO: 392991 - DNA, 589 bp, Homo sapiens
  misc_feature: GZ8MTXP02H8MW3.4.26.C04.1.454.CMB.2.raw
  modified_base (259)..(259): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcctgcaggtctagtcagacgccctcctgactatagtaatgganaactaacttagtttggattggtacctgacaaggaagccgaggggcagtcctaccacagctacatcattcttagtttgggttactaacgtccggggcccgttccggggtccctagacgtaggttcaggtggcagtggactcgagcacagtatttacactagaaaatcgagacgaagagtaggaggcgtaggagggtagttagggttgggtacttacgttaattagttgactagtgactaacgtctacgtaacgtaacgtcccgtacttacgtacgtttacgggacgggaacgggaccgaacgggtaggaacgtacgtaacgaaaacgtacg

SEQ ID NO: 392992 - DNA, 598 bp, Homo sapiens
  misc_feature: GZ8MTXP02JVAF5.4.26.C04.1.454.CMB.2.raw
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaacttattggattggtacctgcagaagccgagggcagtctaccacagctcatcatcttagtttgggtactaacgtccggggcctccggggtcctggacaggttcagtggcagtgatcgaggcactagtatttacactagaaatcagcgagagtaggaggcgtaggaggtagtggttgggtacttacgttaagtttagttaggtaattagacgtaacgtaccttacgtaaaccgtaaaccgtccccgtaccgttaccgtaccggtttaccggggaccggggtaacggggaacccggaaaggggttacggaacggtaactaaccgtaaaaccggtaaccgttacggg

SEQ ID NO: 392993 - DNA, 599 bp, Homo sapiens
  misc_feature: GZ8MTXP02FZUFI.4.26.C04.1.454.CMB.2.raw
  modified_base (238)..(238): a, c, t, g, unknown or other
  modified_base (252)..(252): a, c, t, g, unknown or other
  modified_base (256)..(256): a, c, t, g, unknown or other
  modified_base (294)..(294): a, c, t, g, unknown or other
  modified_base (298)..(298): a, c, t, g, unknown or other
  modified_base (302)..(302): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtggggatattgtgatgactcagtctccactctccctcgcccgtcaccccgtggagacgcccggcctccatcctcctgcaggtctagtcagacncctctgcatagtangganacaacttattggattcggactgcagagccaggcagtcnccangctnatcattcgtagtttcgggttctaacgtccggggtcccgtccggggtccctagaccgttaggttcgaggtggcgtagtcggactcgaggaccaacgacgttaatttaacaacttaagaaaactcgagacgaggtagtggaggtcgtaggtaggtagttgggttacgggtacttacgttattagttgactaagtcgactacggtacctactaacgaccgtcccgtacgtaccgttacggttccgggacggggtaacggaaccggtaagggtacggaagtaacgtaccgaaacggtaacg

SEQ ID NO: 392994 - DNA, 568 bp, Homo sapiens
  misc_feature: GZ8MTXP02GY9YE.4.26.C04.1.454.CMB.2.raw
  modified_base (305)..(305): a, c, t, g, unknown or other
  modified_base (371)..(371): a, c, t, g, unknown or other
  modified_base (518)..(518): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggtctattttaaaaggtgtcagtgtgaggtgcagttggtggagtctgggggaggcttggtacagccgtgggggtccctgagactctcctgtacagactctggatcacctttagcagccatgccatgagctgggtccnccaggctccaaggggaagggctgggagtgggtctcaggcaattgtggaggtggtggtggtggtacntactacgacaaaacgtccgtagacggggcccgaaattccgaccctaatctacccagacgacaaattacccaaagaaacacgttaatatactagacaaaatgaaacaagccagacgagaccgaccgacacgggcctaatacttaacgngtacgacgtaaactcgtacttaagtacgacgaccgagacgtacgcgtagg

SEQ ID NO: 392995 - DNA, 665 bp, Homo sapiens
  misc_feature: GZ8MTXP02JZUJM.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctgtactttttcttgtggctattttaaaaggtgtccagtgtgaggtgcaggttggtggagtcgtggggggaggcgttggtacacggccgtgggggggtccctggagactctcctgtacagactctggattcacctttagcagccatgccatgagcgtgggtccgccaggcctccgaggggaaggggctgggagtcgggtctcgagctaaagttaggtggggagggttgggtggggttggtggtacagtacgtacgacaaaacgtccggtagggacggggtcccgtatttccgaccctattccctcccgaaagacgaacctaaactttacccaaaagtaaaccctaacgtttaatatactagactaaaatacgaaacacgccgtaggaccggacggcccgaaccgaaccgacccgggtaccgttaagttaacttaccgtagtacggtaccgtaaaacgttcggtaccctttaagttccggaaccggtaccggagccggttaacggcctagggg

SEQ ID NO: 392996 - DNA, 764 bp, Homo sapiens
  misc_feature: GZ8MTXP02IH3N1.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtcttttctgtggctattttaaaaggtgtccagtgtgaggtgcagttggtggagtctgggggagcttggtacagccgtgggggtccctgagactctcctgtacagactctgattcaccttagcagccatgccatgagctggtccgcaggctccgagggaaggggctgggaggtgggtctcgagactaattaggtgggtagggtggtggggtggtagggtacctagtacctaacggacctaaaaacccgttcccgggtagggacggggggtacccgtaacgtttaccgacccgtaaacgtcccttaacccgtaaggtaaacggaaacccgtaaaacgttttacccccaaaaaagggtaaaacccgtaacccgttttaaaacgttaagtttaaaccccttacggaaacgtaaaatttacgggaaaacctaaaccgggaccttacggcgaacggaccccgaaaccgtaaccggaaccccgggtaacccgggttaaagttaaaccctttacgtttaacggtacgacccggtaaaaacttggtaacccctttttaaagtttcggtaacccggtaaccccggaaaggtcccggtttaacggaacgtttacgggg

SEQ ID NO: 392997 - DNA, 652 bp, Homo sapiens
  misc_feature: GZ8MTXP02G9786.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtctttttcttgtggtctaattttaaaaggtgtccagtgtgaggtgcagttggtggagtcgtgggggaggcttggtacaggccgtgggggtccctgagactctcctgtacagactcgtggtattcctacctttagcagccatgccagtgacgtcgtcgggtccgccgtaggcctaccggaagggggaacggggcgtggggaggttggggtctacgagtacgtaaagttaggtgggtagggtgggtgggttgggtagtaactagtacgtacgaccaaacgtccgggtaggacgggccgtaattccaaccgtatcctaccgaagtaacgaacctaaacttacccgaaaagtaacctacgtttaatacttacgtacgaactaaatacggaaactacgcctacggacgacgaccggaacgaacgccgggtactaactagtacgtacgacgtaacgtaattcgtacctttaagcggaccgtacgagtcggtaacgcgtagg

SEQ ID NO: 392998 - DNA, 668 bp, Homo sapiens
  misc_feature: GZ8MTXP02FS0Q5.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtggtcttttctgtggctaattttaaaaggtgtccagtgtgaggtgcagttggtggaggtcgtgggggagcttggtacagccgtggggggtccctgagactctcctgtacagactctggtattcacctttagcagccatgaccatgagcgtgggtcccgccgacggcctccggaggggaacggggtctggggaggtggggtcctcgagtacgtaagtttaggtaggggtagggtggggttggggtggttacgggtaactagtaacgtaaacggtactaaaaccgtccgggtaggaacgggggtcccgtaattcccgaaacctattcccgaccgaaggacaacctaaacttacccgaaagtaaacctaacgtttataacctatacgactaaagtacgaaacgtacgccgtagaccggacgaccgaaccggaacgaccggtaccgtaagttacttacgtagttacgaacgtaaatcgttacctaaggttacgaccgtacgacgcgtacggctaggg

SEQ ID NO: 392999 - DNA, 627 bp, Homo sapiens
  misc_feature: GZ8MTXP02HTYSF.4.26.C04.1.454.CMB.2.raw
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttggtggagtcgtgggggaggtcttggtacgagccgtggggggtccctggacgactctcctgtacagactctggattcacctttagcagcccatcgccagtgagtcgtgggtcccgccaggcctaccggaggggaacggggtcgtgggaggtgggtctcgagctaaagttggaggtaggggtggtgggtggtagtacagtacgtacgactaaaccgtcggtagggacgggccgtacttacgacccatccgtacagaacgtaaactaacgttacccaaaagtaacctaacgtttactactactagtaaccaaatacgaactacgccgtagcgacgaccgacgacacggtccgtaattacgttactaggtacgaacgtaacgtcgtacgttaagttccgacgtaccgagtaccgtagacgtagg

SEQ ID NO: 393000 - DNA, 684 bp, Homo sapiens
  misc_feature: GZ8MTXP02FO7PI.4.26.C04.1.454.CMB.2.raw
  modified_base (251)..(251): a, c, t, g, unknown or other
  modified_base (298)..(298): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagacgcctctgcatagtatgganacaactatttggattggtacctgacaagaagccagggcagtctccanagctacatcaagttcttagtttcgggttactaacgtccggggacccgttccggggtccctaggtaccgtagggtttccagttggacgtagtacggatccgaggaccaagtagttaactttaacaacttaagaaaactcgaaagcgaaggacggtaggagggtacgtaggtaaggggtagttgggtttaggggtcctttacgttaattttaacgttcgtacgttaagtacgtaacgtaaacggtaccttaaccgtaaacccgttaacccggtaccccgtaccgtttacccggttaaccgggtttaccgggggaaccggggtaaaccgggtaaaccggtaaacggggtacgggtaacgtaaaacgtaaaaccggaaaaccggtaacgg

SEQ ID NO: 393001 - DNA, 700 bp, Homo sapiens
  misc_feature: GZ8MTXP02I3LLJ.4.26.C04.1.454.CMB.2.raw
  modified_base (269)..(269): a, c, t, g, unknown or other
tcagagcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaaagaacacgttatatctgacaaatgaacngcctgcgagccgacgacacggccgtatacttacgtgtgacgaaattcgtacctttagtcggcgaacccggagcgtagcgaggtggcttgggtcgacaacgtcgggccttacccggacccccgtgggggacccaacggggaaacccctagttcgtacccaccgttcctcctcaccggccctcccgaacccgaacgggcccctacgttcccgggttcccttccccccgcgggtcccgtccccgtcgcccgtacccgacgggacccgtacccgtaccccgtacccggaaccgaaacccgaccggaccgggcccgggtccccgtcggggcccgttccggacccgttacgggtaaccgtaaaccgggtacctttaccccgttacccgtacgtacgtccgtacctcggttacggacggtccgggcgtacggaaccgg

SEQ ID NO: 393002 - DNA, 615 bp, Homo sapiens
  misc_feature: GZ8MTXP02HRZZV.4.26.C04.1.454.CMB.2.raw
tcagagcactgtagcacgaccggtgctcgatttagtctagcgactttgggtttggggtgatcaggactcctcagttcaccttctcacaatgaggctccctgctcagctcctggggctgctaatgctctgggtctctggatccaggtggggatattgtgatgactcagtctccactcctccctgcccgtcaccccgtggacgacgcccggcctccattcctccgtgcaggtctagcagcgcctctgactagtagtagtggaagaactaacttagttggagttcggtacctgacgaagacgccgagggtcacgtcctaccagacgcctacactctattcgtttaggtttcggttactacggtcccgggtaccccgtcggtcctgaccgtaggttcgaggtgacaggttgacgtcgaacggctaacgtattaactttacgaataacgtaaaatcgagtacgaggtaggtggagtcgtaggtaggtagttggtggtcttagttattgtgtacctagtcgacgtaacgtctaacgtacgtaacccggtccctaacgtccgttaccggttacgggacggtaacggtacgaagggtcgaagtacctaacggtaaaacgtcgg

SEQ ID NO: 393003 - DNA, 773 bp, Homo sapiens
  misc_feature: GZ8MTXP02IF7UL.4.26.C04.1.454.CMB.2.raw
  modified_base (276)..(276): a, c, t, g, unknown or other
  modified_base (311)..(311): a, c, t, g, unknown or other
  modified_base (318)..(318): a, c, t, g, unknown or other
tcagagcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagttggtggagtcgtgggggaggcgttggtacaggccgtggggggtccctggagactctcctgtacagactcnggattcaccttagcagccatgcatgagctggtccnccaggcncgaggggaagggctgggaggtgggtctacgagacgaaagttacggaggggtagggtgggtggggttaggtacggttaactacgttaaaccgtaacgtaaaccgtaaaaccgttaccggggtacgggtaaacggggtaccctaaacgtttacccaaacctaacgtacccgtaacccgaaaggaacgtaaaactaaaacgttaaaacccaaaaggtaaacctaaacgtttaaagtactttaccgtaagtaaaccaaaaagttaaccgaaacgtaacgacccgtaggacccggaacggaacccgaaaccgaaccgaacccgggtaacccgtaaattttaagttaaaccgtagggtaacgtaaaccgggtaaaaacttcccggttaacccgtttaacggtttaccggaacccgggtaaaccggtaaacggtacccggtaaaggttacccgaaacggggg

SEQ ID NO: 393004 - DNA, 531 bp, Homo sapiens
  misc_feature: GZ8MTXP02IUBAK.4.26.C04.1.454.CMB.2.raw
  modified_base (231)..(231): a, c, t, g, unknown or other
  modified_base (295)..(295): a, c, t, g, unknown or other
  modified_base (436)..(436): a, c, t, g, unknown or other
  modified_base (443)..(443): a, c, t, g, unknown or other
tcagagcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagngcctctgcatagtaatggagacaactattggattggtacctgcagaagccagggcagtctccanagctcatcatctattggtctaacgtccgggtcctcggggtccctgactaggttcgagtggcagtcggatcgagcacagtatttacactagaaatcagcgagagtgaggactggaggtatggttgggacctgtattagtgangttacgntacgtctactaacgtacgtaccgtcgtaccgtacggttcggacgggaaggtaaccgtaagggtacggaacgacgtaacgaaacgtacg

SEQ ID NO: 393005 - DNA, 510 bp, Homo sapiens
  misc_feature: GZ8MTXP01DZA7P.51.3.A03.1.454.CMB.2.raw
tcagcgatcgtatacacgaccggtgctcgatttagagagcgtcacaggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagccaggccaggcccctgtcttggttattataaagctttgagaggccctcgagggacccctgagcgattctctcggctcagctcaagcgaacaacagtcacgttgaccatcagtgagtccaggcagaggacgaggctgactatactgtcagtcatcagcagcagtggcacttatgtcgtattcgggcggaggggacctaaacgttcgaccgttccctaagggtcaacggccccaagggccttcgcccccgttccggg

SEQ ID NO: 393006 - DNA, 518 bp, Homo sapiens
  misc_feature: GZ8MTXP01A8XC7.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagtactttgagacggccctcgacggggacccctgagcgtattctctcggctcagctcaagcgaacacagtcacgttgaccatcagtggagtccgaggcagaggacgagggctgactattactgtcagtcatcagacagcagtggctattatgtaacgtcgttcggcgggttaacgggaaccaacttcggaccgttccgtaaggcaagcccgaaggcctcgcccccgtcgg

SEQ ID NO: 393007 - DNA, 508 bp, Homo sapiens
  misc_feature: GZ8MTXP01B47WR.51.3.A03.1.454.CMB.2.raw
  modified_base (302)..(302): a, c, t, g, unknown or other
tcagcgatcgtatacacgaccggtgctcgatttagagagcgtcacaggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttattataaagctttgagaggccctnacgggacccctgagcgattctctcggctcagctcaagcgaacaacagtcacgttgaccatcagtgagtccaggcagaggacgaggctgactattactgtcagtcatcagacagcagtgctacttatgtcgtagttcgggacggagggaaccaaacgttcgaccgttcctaagggtcaacgccccgaaggcctccgcccccgttcgg

SEQ ID NO: 393008 - DNA, 601 bp, Homo sapiens
  misc_feature: GZ8MTXP01C5W9D.51.3.A03.1.454.CMB.2.raw
  modified_base (212)..(212): a, c, t, g, unknown or other
tcagcgatcgtatacacgaccggtgctcgatttagagagcgtcacagggggtgggtccaggaggcagaactctgggtgtctcaccatggcctggatccctctacttctcccctctcactctctgcacaggctctgaggcctcctatgagctgacacagccaccctcggtgtctgtgtcctcaggacagacggccaggatcactgctctgganatgcattgaccaaagcaaatatgcttactggtaccagcagaagccaggccaggcccctgtcttggttattataaagctttgagaggccctgacgggtacccctggacgcgatttctacgtcggcctcagccttacgaacgtcgaacaaactagtactacgttcgaccagtcagttggacgttcccgaggtcaggaacggacgtagggctagaacgttattacgtgttacgaggttcaattcgaagtaccagcctaagtcggtactacgttagtgtcgtagtttcgggacggttacgggtaaccctaaacgttcggacccggttaccgttaaggggtacctaacggtaccccgaaagggttcccgttccggccccccgttttaaccgggg

SEQ ID NO: 393009 - DNA, 524 bp, Homo sapiens
  misc_feature: GZ8MTXP01CEETH.51.3.A03.1.454.CMB.2.raw
  modified_base (289)..(289): a, c, t, g, unknown or other
  modified_base (422)..(422): a, c, t, g, unknown or other
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctctggagatgcattgaccaaaagcaaatatgcttactggtaccagcagaagccaggcaggcccctgtcttggttatttanaaagtactttgagacgccctcgacgggacccctgacgcgtattctctcggctcagctcaagcgaacaaacagtcacgttgaccatcagtgagtcaggcagagacgaggctgactatactgcagtcatcagacngcagtggctattatgtaacgtagttcgggacggagggaaccaaagttcgacccgttccgttaaggaccaacggcccaagggttccaaccgcccccgttccgg

SEQ ID NO: 393010 - DNA, 504 bp, Homo sapiens
  misc_feature: GZ8MTXP01C9C7A.51.3.A03.1.454.CMB.2.raw
  modified_base (426)..(426): a, c, t, g, unknown or other
  modified_base (446)..(446): a, c, t, g, unknown or other
  modified_base (483)..(483): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaatatgcttactggtaccagcagaagccaggccaggcccctgtcttggtttattataaagactttgagacggccctcgacgggacccctgagcgtattctctcggctccagctcaacgcgaacaacagtcacgttgaccatcagtggagtccgaggcaggagacgagctgactattactgtcagtcatcagacngcagtgctacttatgtcgtnttcgggacggaggaccaagttcgacttcgtaaggtcnggccagacgtcgcccgtcccg

SEQ ID NO: 393011 - DNA, 510 bp, Homo sapiens
  misc_feature: GZ8MTXP01CSQ8B.51.3.A03.1.454.CMB.2.raw
  modified_base (392)..(392): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcactgctctggagatgcattgaccaaagcaatatgcttactggtaccagcagaagccaggccaggcccctgtcttggttatttataaagtactttgagacggccctcgacgggacccctgagcgattctctcggctcagctcaagcgaacaacagtcacgttgacatcagtgagtcaggcagaggacgagcngactatactgtcagtcatcaagacagcaggtgctacgttatgtcgtagttcgggacggagggaaaccaacgttcgacccgttcgtaaggtccaacgcccagggcctcgccccgttcgg

SEQ ID NO: 393012 - DNA, 513 bp, Homo sapiens
  misc_feature: GZ8MTXP01DOQY0.51.3.A03.1.454.CMB.2.raw
  modified_base (392)..(392): a, c, t, g, unknown or other
  modified_base (434)..(434): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttattataaagactttgagaggccctcgacgggacccctgagcgattctctggctcagctcaagcgaacaacagtcacgttgaccatcagtggagtccaggcagaggacgaggcngactattactgtcagtcaatcagacagcaagtggctacttangtcgtattcgggcgggttagggaccaaacgttcgaccgttccgtaagggtcaacgcccaagggcctcgcccccgttcgg

SEQ ID NO: 393013 - DNA, 525 bp, Homo sapiens
  misc_feature: GZ8MTXP01D976V.51.3.A03.1.454.CMB.2.raw
  modified_base (444)..(444): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccaggcccctgtcttggtttatttataaagtactttgagacggcccctcgacgggacccctgagcgtattctctcggctcagctcaagcgaacaaacagtccacgttcgaacctatcgagtggacgtccgaggcaggaggacgaggctagactattactgtcagtcatcagacagcagtgntacttatgtaacgtagttcgggacggaggaaccaaacgttcgaccgttctaaggtcaacgtcccaggcctcgccccgttcg

SEQ ID NO: 393014 - DNA, 506 bp, Homo sapiens
  misc_feature: GZ8MTXP01BETDQ.51.3.A03.1.454.CMB.2.raw
  modified_base (355)..(355): a, c, t, g, unknown or other
  modified_base (413)..(413): a, c, t, g, unknown or other
  modified_base (434)..(434): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagtactttgagaggcccctcgacgggacccctgagcgtattctctggctcagctcaagcgaacaacngtcacgttgaccatcagtggatcaggcagagggacgaggctgactattactgtcagtnatcagacagcagtgctacttntgtcgtagttcggggcggagggaccaaacgttcgaccgttcgtaagtcaagcccgaaggcctcgcccctcgg

SEQ ID NO: 393015 - DNA, 532 bp, Homo sapiens
  misc_feature: GZ8MTXP01EPHMU.51.3.A03.1.454.CMB.2.raw
  modified_base (446)..(446): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagcccaccctcggtgtctgtgtcctcaggacagacggccaggatcacctgctctggagatgcattgaccaaaagcaaatatgcttactggtaccagcagaagccaggccacggcccctgtcttggttatttataaagtactttgagaggccctgacgggacccctgagcgtattctctcggctcagctcaagcgaacaaacagtcacgttgaccatcagtgagtccagcagaggacgaggctgactagttactgtacagtcatcgaagacagcgaagtggcctattagngttcgttaagttcggggcggaacgggaaccgtaaacgttcggacccgttacgaaggtacaacggcccaaggcctccgccccgttcg

SEQ ID NO: 393016 - DNA, 517 bp, Homo sapiens
  misc_feature: GZ8MTXP01C6EZ4.51.3.A03.1.454.CMB.2.raw
  modified_base (213)..(213): a, c, t, g, unknown or other
  modified_base (426)..(426): a, c, t, g, unknown or other
  modified_base (428)..(428): a, c, t, g, unknown or other
  modified_base (438)..(438): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcactgctctgganatgctattgaccaaaagcaaatatgcttactggtaccagcagaagccaggccaggcccctgtcttggttattataaagactttgagaggccctgacgggacccctgagcgattctctcggctcagctcaagcgaacaaacagtcacgttcgaccatccagtggagtccgaggcaaggaggacgaggctgactattatgtcagttcatcagacngnagtgcattangtcgtaagttcgggaggacgggaacaaacgttcgaccgttcgtaagggacaacggcccaagggcctcgcccccgttcgg

SEQ ID NO: 393017 - DNA, 517 bp, Homo sapiens
  misc_feature: GZ8MTXP01AMJAJ.51.3.A03.1.454.CMB.2.raw
  modified_base (355)..(355): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagaggcccctcgacgggacccctgagcgtattctctcggctcagctcaagcgaacaacngtcacgttgaccatcagtggagtcaggcagaggcgaggctgactatactgtcagtcatcagacagcagtggctacttatgtcgtagttcgggacggagggaaccaaacgttcggcccgttccgtaaggtccaacggcccaagggcctccgcccccgttccgg

SEQ ID NO: 393018 - DNA, 520 bp, Homo sapiens
  misc_feature: GZ8MTXP01B53YI.51.3.A03.1.454.CMB.2.raw
  modified_base (243)..(243): a, c, t, g, unknown or other
  modified_base (435)..(435): a, c, t, g, unknown or other
  modified_base (455)..(455): a, c, t, g, unknown or other
  modified_base (496)..(496): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttacnggtaccagcagaagccaggccacggcccctgtcttggttattataaagtctttgagacggccctcgacgggaccctgagcgtattctcgtcggctcagctcgaagcgaacaaactagtccacgttcgaccatcgagtgacgtcagggcaaggagggacgaggctagactattactgtacagtcatacagacngcaaggtcgtactacttagnggtaacgtagttcgggacggaggaaccaagttcgacttcgngtcaagcccagcctccgcccgtcg

SEQ ID NO: 393019 - DNA, 538 bp, Homo sapiens
  misc_feature: GZ8MTXP01BOMZB.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgccaggccaggcccctgtcttggttattataaagtctttgagagccctcgacgggacccctgagcgtattctctcggctcgagctcgaagccgaacaactacgtcacgttgaaccatcagtggacgtaccgaggacgaggaagggacgaggctagaccttattacgtgtcgagttcatcgaagacagcgaagtgtctacttatggtcgttgttcgggacggacggaaccaacgttcgaccgttccgtaaggtcgaacgccgaacggctcccgccccgtccg

SEQ ID NO: 393020 - DNA, 537 bp, Homo sapiens
  misc_feature: GZ8MTXP01CZU7O.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcactgctctggagatgcattgaccaaaagcaaatatgcttactggtaccagcagaagccaggccaggcccctgtcttggttattataaagtactttgagaggccctcgacgggacccctgagcgtattctctcggctcagctcaagcgaacaacagtacacgttcgaccatcagtggatcgaggcagagagagctagactatactgtcagtcatcagacagcaaggtcgtactacttagtcgtaacgtaacgttcgggacggacgggtaaacccaacgttcggacccgttacgtaaggtaccgaacggacccgaaggcctccggcccccgttaacgg

SEQ ID NO: 393021 - DNA, 518 bp, Homo sapiens
  misc_feature: GZ8MTXP01AF6O8.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccaggcccctgtcttggttattataagactttgagaggcctcgagggacccctgagcgattctcgtcggctcagctcaagcgaacaacagtcacgttgacatcagtggagtcaggcagaggacgagcagactatactgtcagtcatcagcagcagtgctattatggtctgttcgggcggagggaacctaaacgttcggttaccgttccgttaacggccaacggtccccgaagggttcctcccgcccccgttccgg

SEQ ID NO: 393022 - DNA, 546 bp, Homo sapiens
  misc_feature: GZ8MTXP01CQG7U.51.3.A03.1.454.CMB.2.raw
  modified_base (436)..(436): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaaatatgcttactggtaccagcagaagccaggccacggcccctgttcttggttatttataaagtactttgagacggccctcgacgggacccctgagcgattctctcggctcagctcaagacgaacaacagtcacgttcgacctatacaggtggacgtccgaggcaggaggacgaggctgactattactgtcgagtcatcagacngcgagtggtctacgttatggtaacgtagttcgggacgggacgggaaacctaagttcggttccgttaccgtaaggtaccaacggacccgacggccgtccgcccccgttcgg

SEQ ID NO: 393023 - DNA, 524 bp, Homo sapiens
  misc_feature: GZ8MTXP01B0R3Q.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagtactttgagacggccctcgacgggacccctgagcgattctcgtcggctcagctcaagcgaacaacagtcacgttgaccatcagtggacgtccgaggcgaggacgggacgaggctaggacttattactgtacgagtcatcagacagcagtgctacttagtgtcgtagttcgggcggaggaccctaaagttcgaccgttccgtaaggtcaacgcccgaggcctccgccccgtcgg

SEQ ID NO: 393024 - DNA, 653 bp, Homo sapiens
  misc_feature: GZ8MTXP01C1MIS.51.3.A03.1.454.CMB.2.raw
  modified_base (183)..(183): a, c, t, g, unknown or other
  modified_base (214)..(214): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctnaggacagacggccaggatcactgctctgganatgcattgaccaaagcaatatgcttactggtaccagcagacgccacggccacggcccctgtcttggttaatttataaagtactttgagacggccctacgacgggacccctgacgcgtattctctcggcctcgagcctcgaacgacaacaaacgagtacacgttacgacctagtcgagtggacgtaccgaggccgaagggaacgggacggacggtaccgtaggtaaaccttatttaaccgtggtactaacggttccaaacggttaccgggaaacctaggaccgtaaggttaccgggacttaccgtttaagtcggtttcccggttaaaggtttccggggacggggtaacggggaacccttaaaacggtccgttaccggttcccgttagggaacccaacggcccgtaacgggcccttaccggtcccccgttaagggttcccc

SEQ ID NO: 393025 - DNA, 589 bp, Homo sapiens
  misc_feature: GZ8MTXP01DK593.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttaggtttatttaataaagtactttgagacggccctcgacgggacccctgacgcgtattctcgtcggcctcagctacgaagaccgaacaacagtacacgttcgaccctatcgagttcggagtacccgagggaccaagggaacgggacggagggtcctaggaacctttaagttaacttcggttacgagttccaatacaacggacagcaaggtcgtctacgttagtgttaacgtagttccgggacggttaacggggaacccaagttcggcccgttacgtaaggtcaacggcccaggcctaacccgccccgttccg

SEQ ID NO: 393026 - DNA, 552 bp, Homo sapiens
  misc_feature: GZ8MTXP01A6CHV.51.3.A03.1.454.CMB.2.raw
  modified_base (430)..(430): a, c, t, g, unknown or other
  modified_base (444)..(444): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccaggcccctgtcttggttattataaagtactttgagacggccctcgacgggacccctgagcgtattctctcggctcgagctcgaagcgaacaacagtaccacgttgaccatcagtggagtccgaggacagaggtacgaggctagactatactgtcagtcatcagacngcagtgctacttanggtaacgtagttcgggaggttaacgggaacctaaacgttcggttacccgttacgtaacggggtccaacggaccccgaacgggttccttcccggcccccgtttcccggg

SEQ ID NO: 393027 - DNA, 555 bp, Homo sapiens
  misc_feature: GZ8MTXP01EQ9Y6.51.3.A03.1.454.CMB.2.raw
  modified_base (405)..(405): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaaatatgcttactggtaccagcagaagccaggccacggcccctgtcttggttattaataaagtatttgagacggccctcgacgggaccctgagcgattctcgtcggcctcgagcctcaacgccgaacaacagtcacgttgaccatcgagtggactccagggcaggagggacgnggcagactattacgtggtacagtcatcagacagcagtggctacttagtggtcgttagttcggggacggttacgggaaacctaaacgttcggttaccgttacgtaacggtcaacggacccaacgggttcctcccggttaaccccgttccgg

SEQ ID NO: 393028 - DNA, 620 bp, Homo sapiens
  misc_feature: GZ8MTXP01DGP7R.51.3.A03.1.454.CMB.2.raw
  modified_base (215)..(215): a, c, t, g, unknown or other
  modified_base (369)..(369): a, c, t, g, unknown or other
  modified_base (460)..(460): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgctattgaccaaagcaaatatgcttactggtaccagcaagaacgccgaggccacggtcccctgtcttggtttaatttataaagtctttgagacggccctcgaacgggtaccctgacgcgtattctctcggcctcagctcaagcgaacaaacngtaccacgttagacctatcgaggttggacgtccgaggccgaaaggacggtaccgagggctagtaaccttagttaacgtcgtacgtaacgtnactacgaacgaccgaagccgtaaggtcggtactacgtttagtggttccggttaacgtttcggggaaccggagggtaaaccctaaacggttccgttacccgttaccgttaacgggaccaacggccccgaagggttccctcccggttaacccccgtttccgg

SEQ ID NO: 393029 - DNA, 509 bp, Homo sapiens
  misc_feature: GZ8MTXP01AUMZE.51.3.A03.1.454.CMB.2.raw
  modified_base (392)..(392): a, c, t, g, unknown or other
  modified_base (409)..(409): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacgccaggatcacctgctctggagatgcattgccaaagcaatatgcttactggtaccagcagaagccaggccaggcccctgtcttggttatttataaagactttgagaggccctcacgggacccctgacgcgattctctcggctcagctcaagcgaacaacagtcacgttgaccatcagtgagtccaggcagaggacgaggcngactatactgtcgagtnatcagacagcagtgctacttatgtcgtattcgggcggaggggtaccaaacgttggaccgttccgtaagggcaacgcccaacgggctcgcccccgttccgg

SEQ ID NO: 393030 - DNA, 517 bp, Homo sapiens
  misc_feature: GZ8MTXP01BN5NY.51.3.A03.1.454.CMB.2.raw
  modified_base (436)..(436): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttggttattataaagtactttgagagccctcgacgggaccctgagcgattctctcggctcagctcaagcgaacaacagtctacgtcgaccatcgagtggatccgaggcaggaggacgaggctgactatactgtcgagtcatcagacagcagtgcctattangtcgtagttcgggacggagggaaccaaacgttcggaccgttcccgtaaggtccaacgcccgaggccttccgccccgttcgg

SEQ ID NO: 393031 - DNA, 561 bp, Homo sapiens
  misc_feature: GZ8MTXP01B3ZW4.51.3.A03.1.454.CMB.2.raw
  modified_base (183)..(183): a, c, t, g, unknown or other
  modified_base (215)..(215): a, c, t, g, unknown or other
  modified_base (293)..(293): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctnaggacagacggccaggatcacctgctctgganatgcattgaccaaagcaatatgcttactggtaccagcagaagccaggccacggcccctgtcttggttattataaagtntttgagacgcctcgacgggaccctgagcgattctcgtcggctcagcctacgaacgcgaacaacagtcacgttcgaccatcgagtggacgtccgaggcaggaggacgaggctagacttagttactgtacagtcatacgagacagcgtaaggtcggtcctaagtttagtcggttaacgttacggttcggggacggttaacggaaaccctaacgttccggttccgttacgtaaggccaaccgacccgaggccctaacccgccccgttccgg

SEQ ID NO: 393032 - DNA, 535 bp, Homo sapiens
  misc_feature: GZ8MTXP01ESY4W.51.3.A03.1.454.CMB.2.raw
  modified_base (444)..(444): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaatatgcttactggtaccagcagaacgccaggccacggccccctgtcttaggtttaatttaataaagtactttgagacggccctcgacgggacccctgagcgtattctcgtcgctcagctcaagcgaacaacagtccacgttgaaccatcgagtggacgtccgaaggcaggaggacgaggctagacttaattactgtacagtcatacagacngcagtgctatatgtcgtagttcgggcggttaagggacctaaagcgttccgttactaacgggcaacgacccgaggcctccgcccccgtaacg

SEQ ID NO: 393033 - DNA, 555 bp, Homo sapiens
  misc_feature: GZ8MTXP01EL8U0.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattcgaccaaagcaatatgcttactggtaccagcagaagccaggccacggcccctgtcttggttatttaataagtctttgagacgccctacgacgggacccctgagcgtattctcgtcgctcagctcgaacgcgaacaacacgtactacgttcgaccatcgagtgacgtcgaggcaggaggacgtagcgtagacttagttactgtcagtcatacagacgagacgtaggtcgacttagttagtggttaacgtcggttccgggacgggaacggtaacccgtaaacgttcgcccgttaccggttcgacgccgacccgagttcccgtccgcccccgttgg

SEQ ID NO: 393034 - DNA, 667 bp, Homo sapiens
  misc_feature: GZ8MTXP01DV6NI.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcactgctctggagatgcattgaccaaagcaatatgacttacgtggtaccagcaagaacgccgacggccacggcccctgttcgtttggtttaatttaataaagtactttggagacggtccctcgaccgggtacccctgagcgtattctcgtcggcctcgagtcctcaacgacgaacaaacgtcgtacgacgttacgaacctatacgaggtggacgtaccgaggacgaaggaacgggacgacgggtctaaggtaaccttagtttaacgtcggttacgtaacggttaccaagttacccgaaaggaacccgaggtaccgtaaagggttcggacctttaacgtttagttcgggttaaaccgggtttacggttaccgggggaaccggggaaacgggtaaaccctaacggttacgggttacccttacggtaacggtaccgaacgtacccggacgttccgtcccgccccgttcg

SEQ ID NO: 393035 - DNA, 543 bp, Homo sapiens
  misc_feature: GZ8MTXP01CFJKJ.51.3.A03.1.454.CMB.2.raw
  modified_base (295)..(295): a, c, t, g, unknown or other
  modified_base (377)..(377): a, c, t, g, unknown or other
  modified_base (441)..(441): a, c, t, g, unknown or other
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggcaggatcacctgctcgtggagatgcattgaccaaagcaaatatgcttacgtggtaccagcaagaacgccaggccacggcccctgtcttaggttatttaanaaagtacttgagacgcctcgacgggaccctggacgcgattctcgtcggcctcagctcaacgcaacaaacagtaccacggttnaacctatcgagtggacgtaccgaggcagacggtacgagctagacttaagtactgtacagtcaanacagagagagagtgtctactacgtgtcgtacggttcggacggacggaaccgtaacgttacgcgttacgtaacgacgaacgaccgacgccgtccgcccgtccg

SEQ ID NO: 393036 - DNA, 535 bp, Homo sapiens
  misc_feature: GZ8MTXP01EBHYI.51.3.A03.1.454.CMB.2.raw
  modified_base (288)..(288): a, c, t, g, unknown or other
  modified_base (357)..(357): a, c, t, g, unknown or other
  modified_base (396)..(396): a, c, t, g, unknown or other
  modified_base (423)..(423): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttggttatttanaaagtctttgagaggccctgacgggacccctgacgcgtattctctcggctcagctcaagcgaacaaacngtcacgttagaccatcagtgatcaggcagaggacgagcngactattactgtacgagtcatcagacngtcagtgctattatgtcgtaagttccgggacgggacgggaacctaaacgttcgaccggttaccttaagggccaacggaccccgaagggcccttaaccggcccccgttccggg

SEQ ID NO: 393037 - DNA, 534 bp, Homo sapiens
  misc_feature: GZ8MTXP01ADB2R.51.3.A03.1.454.CMB.2.raw
  modified_base (443)..(443): a, c, t, g, unknown or other
  modified_base (452)..(452): a, c, t, g, unknown or other
  modified_base (459)..(459): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaaatatgcttactgtaccagcaagaacgccaggccacggtccccctgttcttaggtttatttataaagactttgagacgccctcgacgggacccctgagcgattctcgtcggactcgacgctcaacgcgaacaacacgtcacgttgacctatcgagtggacgtccgaggcaaggaggacgaggcctagactattacgtgtcagtcatcagacngcaggtcgntaacttnggtcgtagttcgggacgacgggtaaccaagttcgaccgttctaagggcaacggcccaggcctcccgccccgttcg

SEQ ID NO: 393038 - DNA, 651 bp, Homo sapiens
  misc_feature: GZ8MTXP01CTJ11.51.3.A03.1.454.CMB.2.raw
  modified_base (209)..(209): a, c, t, g, unknown or other
  modified_base (214)..(214): a, c, t, g, unknown or other
  modified_base (478)..(478): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcactgctntgganatgcattgaccaaagcaaatatgcttactggtaccagcagaacgccaggccacggcccctgtcttggttattataagtcttgagacgcctgacgggaccctgagcgtattctcgtcggcctacagtctacgaacgacgtaacaaactcgtaccgtacgttacgacctatacgaggttaggacgtccgagggacaggagggaccggaggccgtagtacttacgtttaaacgtcgtacgtacggtcaacgttacgaagtaacccgnggtacgtaaacgggttcgggtaccttaaaccgtttagttcgggttaacggttacgtttccgggggtaacgggaccgggtaaaacccgtaacgttaccggttacccggttaccgttaacgggacccgtaaccggaaccccgaacgggacccccaaaccccgttcgttaacccgg

SEQ ID NO: 393039 - DNA, 552 bp, Homo sapiens
  misc_feature: GZ8MTXP01C5AFC.51.3.A03.1.454.CMB.2.raw
  modified_base (434)..(434): a, c, t, g, unknown or other
  modified_base (448)..(448): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagcggccaggatcactgctctggagatgcattgaccaaagcaatatgcttactggtacagcagaagccaggccaggcccctgtcttggttatttaataaagtctttggaacgacgtccctacggaccgggtaccctgacgcgtattctcgtcgcctacagcctcgaacgcgaacaacgtacgtacgtacgtacgaacctagtacgaggtgagtcgcgagcgaagaggtacgagctagacttacgtntacgtgacgtcaanacagacgacgacgcgtgtactactgtgtcgttacggtcggacggtaacggaacgacgttcgttacgtaacgtacgtaacgacgaccgacgtccgttccgtcccg

SEQ ID NO: 393040 - DNA, 693 bp, Homo sapiens
  misc_feature: GZ8MTXP01EI8IE.51.3.A03.1.454.CMB.2.raw
  modified_base (214)..(214): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctgganatgcattgaccaaaagcaatatgcttactaggtaccagcagaagccaggccaggcccctgtcttggttaatttaataaagtactttgagacgccctcgacgggacccctgagcgtattctctcggcctcagtctacaacgacgaacaaactacggtacctacgttagaccctagtacgaggtcggaagtcccgagggaccgaaggaacgggtaaccggagggtcctaggtaaccttaatttaaccgtggttacctaaggttaccaattaccgaagaaccgacggacgtaaggtcggtaactacctttaacgtgggttaacccgttaggttaccgggggaccggttaaacgggggaaacccctaaaaacggttcccggttaaccccggtttacccgtttaaacgggggtccccaaaccgggtacccccggaaacggggttaccccttcccccgggttaacccccccgtttaaccccgggg

SEQ ID NO: 393041 - DNA, 556 bp, Homo sapiens
  misc_feature: GZ8MTXP01D7YYJ.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcaagaagccaggccaggcccctgtcttggtttaatttaataaagtactttgagacggcccctcgaccgggacccctgagcgtattctctcggcctccgagctcaacgcgaacaacacgtacacgttcacctatcgaggtggacgtaccgagggcaagggaaggacggaggctagacttattacgtgtcgaagtcatacgagacgagcgaaggtgactacttatggtaacgttagttcgggacggacggaccaaacgttcggaccgttcgtaacggtcaacgcccgaggcctccgccccgttcgg

SEQ ID NO: 393042 - DNA, 761 bp, Homo sapiens
  misc_feature: GZ8MTXP01ET96M.51.3.A03.1.454.CMB.2.raw
  modified_base (202)..(202): a, c, t, g, unknown or other
  modified_base (217)..(217): a, c, t, g, unknown or other
tcagcgatcgtatacacgaccggtgctcgatttagagagcgtcacaggggggtgggtccaggaggcagaactctgggtgtctcaccatggcctggatccctctacttctccccctcctcactctctgcacaggctctgaggcctcctatgagctgacacagccaccctcggtgtctgtgtcctcaggacaggacggccaggntcacctgctctgganatgcattgaccaaaagctaaagtatgtactacgtacgtacgacgacgagacgacgccgacggtaccgtaccgtacgttacgtttacgtttaacgttttaaagttaaacgttaacgttacggtaacggtaccggtacccgtacccggtaacccggtaccggtaccgtacgtacgttacgttacgtccgttacgtacgtacccgtaccgtaaacgtaccgtaaccgaacgtaaccgaaaccgtaacgtaacgtaacgtacgtaacgtaaccgtaacgtacgtaacggtacggaacgtaacggaacggaacggaacggaacggaacggtaacgtaacgtaacgtaacgttaacggttaacgtacgtacgtaacgtacgtaacgtacgaacgaacgacgtacgtacggtacggtacgttaacgttacgttacggttacggttaacggtaaccgggtaacgggttaaccgggttaaaccgttaaaccggtaaccggtaaccggtaaccggtaccggtaccgaccggtaacccggttaaccggtaacccg

SEQ ID NO: 393043 - DNA, 504 bp, Homo sapiens
  misc_feature: GZ8MTXP01BQSGZ.51.3.A03.1.454.CMB.2.raw
  modified_base (438)..(438): a, c, t, g, unknown or other
  modified_base (464)..(464): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaaagcaaatatgcttactggtaccagcaagaagccaggccaggcccctgtcttaggttattataaagtctttgagacggccctcgacgggacccctgacgcgtattctctcggcctcagctcgaagcgaacaacagtcacgtgaccatcagtgagtccaggcaggagacgaggcagactatatgcagtcatcgagacagcagtgactactangtaactagttcggacgaggaccaaancgaccttccgtaagcgaacgcccaggcctccgccccgtcg

SEQ ID NO: 393044 - DNA, 564 bp, Homo sapiens
  misc_feature: GZ8MTXP01EWL70.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccacggcccctgttcttaggtttatttaataaagtactttgagacggccctcgacgggaccctgacgcgtattctctcgctcagctcaagcaacaacagtcacgttcgaccatcgagtggactccgaggcaggaggacgaggctgacttattactgtcgagtcatcagcagctaggtgactacgttagtggttcgttaggttcggggacgggaacgggaaaccctaaacgttcggttacccgttaccgtaaggggtccaacggtacccgacgggttccctcccggttcccccgttaaccgg

SEQ ID NO: 393045 - DNA, 637 bp, Homo sapiens
  misc_feature: GZ8MTXP01DJIY1.51.3.A03.1.454.CMB.2.raw
  modified_base (510)..(510): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacacgcccacccgtggtgtctgtcgtcctgaggacaggacggccgaggactccactgctcgtggatatgactattcgaaccaaagctaaattatcgtacttacgtacggtaacagacaagaacgccgacggaccgaccggtcccctgttcgtttaggtttaatttaaagtaaacgttacgtttaggacggtaccggtccccgtacggacccggggtacccctaggacgacgttacttccgtcgtaccggtccctacgagtcctacgaacgggaccaacgaactacgtacgtacgttacgacctagtcgagtggactcgagcaggagacgagctagactagtacgtgtcacgtanatacgaacgacagcgtaagtcgtacttacgtatggtaacttagggttcgggacggaacggtaaaccacgttacggcccgttacgttaaggacctaacggcccgtacggccgtcccgaacccgttccg

SEQ ID NO: 393046 - DNA, 567 bp, Homo sapiens
  misc_feature: GZ8MTXP01B7PXQ.51.3.A03.1.454.CMB.2.raw
  modified_base (183)..(183): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctnaggacagacggccaggatcacctgctctggagatgcattgaccaaagcaatatgcttactcggtacagacagaacgccgagccacggcccctgtcttggtttatttataaagtcttagagacggtccctcgacgggacccctgacgcgtattctctcggctcagctcagcgaacaacagtcacgttcgacctatacgaggtggacgtacgaggacgaaggaacgggacggaggctaggacttattacgtgttacgagtactatacagacagacgaggtcggtactacttagtcgttaacgtaggttcgggacggacgggtaaccaacgttcgcccgttacgtaacgtccgaacgtacccgaggttccctccggttccccgtcgg

SEQ ID NO: 393047 - DNA, 535 bp, Homo sapiens
  misc_feature: GZ8MTXP01D73TA.51.3.A03.1.454.CMB.2.raw
  modified_base (283)..(283): a, c, t, g, unknown or other
  modified_base (288)..(288): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttacgtggtaccagcaagaagcagccagccctgtcttgtattanaagtnttgagacgcctcgacgggaccctgagcgtatctctcggctcagctcaagcgaacaacagtacacgttcgacctatacgagtggatccgaggcaagacgggacgagggctagaacttattactgtcagtcatcaagcgagcgagtggctaactttagtggtcgttaagttcgggacggagggaacctaaacgttcgttacccgttacgttaaggacaacgcccgaaggcctccggccccgttaacggg

SEQ ID NO: 393048 - DNA, 522 bp, Homo sapiens
  misc_feature: GZ8MTXP01APK9E.51.3.A03.1.454.CMB.2.raw
  modified_base (401)..(401): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagtactttgagacggccctcgacgggacccctgagcgattctctcggctcagctcgaagcgaacaacagtcacgttgaccatcagtggacgtccgaggcaggaggacgaggcngactattactgtcgagtcatcagacagcagtggctacttatggtcgtagttcggggcggagggaacctaagttcgaccgttccgtaaggtcaacgcccgaggttcctaacggccccgtcgg

SEQ ID NO: 393049 - DNA, 539 bp, Homo sapiens
  misc_feature: GZ8MTXP01AN5FZ.51.3.A03.1.454.CMB.2.raw
  modified_base (510)..(510): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagaccggccagggatcacctgctctggagatgcattgaccaaagcaatatgcttactggtaccagcagaacgccaggccacggcccctgtcttggttattataaagtactttgagacggccctcgacgggacccctgagcgattctctcggctcgagctcaacgcgaacacagtcacgttgaccatcagtggacgtccgaggcaggaggacgaggtctgacttattacgtgcagtcatacagtacagcagtgactacgttatggtctaggttcggggacggaacgggaacctaaacgttcggaccgttccgtaagggtaccncggaccccagggccctcggcccccgtcgg

SEQ ID NO: 393050 - DNA, 640 bp, Homo sapiens
  misc_feature: GZ8MTXP01DTS82.51.3.A03.1.454.CMB.2.raw
  modified_base (236)..(236): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatntgcttactggtaccagcagaagccaggccacggcccctgtcttggttaatttataaagtctttgagacgccctcgacgggacccctgagcgtattctcgtcggctcgagctacgaacgcgaacaactagtaccacgttcgaaccctagtacccgaggttacggacgttacccgaagggaccgaagggaacgggaaccggaggtcgtacggtaaacctttaacgttaacgtacgttacggtaacggttactaacgttacccgaagaacccgaggtaccgtaaaggtcgggtaacccttaacgtttaagtcggtaacgttaagttcggggacggttaacgggaaccctaacggttcgttccgttacgtaagactaacgacccgaggttcctccgttcccccgtcgg

SEQ ID NO: 393051 - DNA, 719 bp, Homo sapiens
  misc_feature: GZ8MTXP01CAQWF.51.3.A03.1.454.CMB.2.raw
  modified_base (212)..(212): a, c, t, g, unknown or other
  modified_base (235)..(235): a, c, t, g, unknown or other
tcagcgatcgtatacacgaccggtgctcgatttagagagcgtcacagggggtgggtccaggaggcagaactctgggtgtctcaccatggcctggatccctctacttcctcccctcctcactctctgcacaggctctgaggcctctatgagctgacacagccacctggtgtctgtgtcctcaggacagacggccaggatcactgctcgtgganatgcattcgaccaaagctaaatntgtacttacgtcggtaaccagacaaggaacgccgacggcccgacggtccccttggttacgtttaggtttaatttaaagtaaacgttacgttttaggaacggtacggtccccgtacggaccggggtacccctaggacggtacgttacttccgttcgtcggcctcgacgtcctacgaacgaccgaacaactacgttactacggttacacgtactcgtaggtacggacgtaccgagggaccgaagggaacgggacggtacggcgtacgaactttacgttagtcgtacgtacgtacacgtacgaagacgaggactaaacgggtcgtaacgttacgtttcgtacggttaacgggttacggtttcgggggaaaccggggttaaccggtaaacccgtaacggttacccgggacccgtttaaccgggtaacggtacccgtccggtaaccccggaaccgggttcccgtccccggttcccccgtttaacccggg

SEQ ID NO: 393052 - DNA, 575 bp, Homo sapiens
  misc_feature: GZ8MTXP01AV2YT.51.3.A03.1.454.CMB.2.raw
  modified_base (214)..(214): a, c, t, g, unknown or other
  modified_base (234)..(234): a, c, t, g, unknown or other
  modified_base (446)..(446): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcactgctcgtgganatgcattgaccaaagcaatntgcttactggtaccagcaagaacgccgaggccacggtccccctgttctttaggttatttaagtaaagtactttagagacggcccctagacgggacccctgagtcgtattctcgtcggcctacagcctacgaacgaccgaacaactagtaccacgttcgacctatcgagttgaacgtccgaggcgaggacggacgagggctagactattacgngtacagtcatccgaagcagactaggtcggtactacttagtggtcgttagttcggggacgttacgggaaacctaacgttcgacccgttcgtaacgtccgaacgcccgaaggttcctccgttccccgtccg

SEQ ID NO: 393053 - DNA, 572 bp, Homo sapiens
  misc_feature: GZ8MTXP01BWRUT.51.3.A03.1.454.CMB.2.raw
  modified_base (181)..(181): a, c, t, g, unknown or other
  modified_base (428)..(428): a, c, t, g, unknown or other
tcagcgatcgtatacacgaccggtgctcgatttagagagcgtcacagggggtgggtccaggaggcagaactctgggtgtctcaccatggcctggatcccctacttctcccctcctcactctctgcacaggctctgaggcctcctatgagctgacacagccaccctcggtgtctgtgtcctnaggacagacggccaggatcacctgctctggagatgcattgaccaaagcaatatgcttactggtaccagcagaacgccaggccacggcccctgtctttaggttaatttaagtaaagtactttgagacggccctcgacggacccctgagcgtattcgtcgtcggcctccagctcagacgaacaacagtcacgttcgaccatcagtgacgtcgaggcaggaggacggagactgactatactgtacgagtnatcgagacagcgaaggtcggactacttagtcggttcgttaacgttacgggacgggtaacgggaactaaacgtgttaacgttccggttaccgttaaggtccgaaccggacccgaacgggttcccgtaacccggcccccgttcggg

SEQ ID NO: 393054 - DNA, 518 bp, Homo sapiens
  misc_feature: GZ8MTXP01BGLKK.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagactttgagaggccctcgacgggacccctgacgcgattctctcggctcagctcaagcgaacaacagtcacgttgacatcagtggactccgaggcagaggacgaggctagactattactgtcagtcatcagcagcagtgctactatgtcgtagttcgggcggaacgggaaccaaacgttcggaccgttcgtaaggtcaacgaccccgaaggcctcgcccccgtttaacgg

SEQ ID NO: 393055 - DNA, 534 bp, Homo sapiens
  misc_feature: GZ8MTXP01D8GY0.51.3.A03.1.454.CMB.2.raw
  modified_base (243)..(243): a, c, t, g, unknown or other
  modified_base (509)..(509): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcactgctctggagatgcattcgaccaaagcaatatgcttacnggtaccagcagagccagccacgccctgtcttggttattataagtctttgagacggccctgacggaccctgagcattctctcggctcagctcaacgcaacgaactacgtcacgttcacctatcgagtcggagtaccgaggcaaggacgggacgaggtctagtactaacttacgtgtacgagttcactacaagaccagcgagtcgtctattagtgtaacgtagttcggggacgagggtaaccaaacgttcgaccgttcgaaggtaccnggtcccaggctcccgcccgttaacg

SEQ ID NO: 393056 - DNA, 563 bp, Homo sapiens
  misc_feature: GZ8MTXP01BF6WD.51.3.A03.1.454.CMB.2.raw
  modified_base (463)..(463): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattcgaccaaagcaatatgcttactggtaccagcaagaacgccgaggcccacggccccctgttcgtttaggtttatttaagtaaagtactttgaggacggccctacgacgggacccctggacgacgtacttcgtcgtcggcctcgagtcctcaacgacgaacaacgacgtccacgttcaccagtcagtggagtccgaggcgaggaggacgaggctagactattactgctagtcatcagtacagngagtgtactattgtgtaacgtgttcgggacggacggaaccgaacgttcggaccgttcgtaaggtaccgaacgaccgacggcctaacccgttccccgtccg

SEQ ID NO: 393057 - DNA, 547 bp, Homo sapiens
  misc_feature: GZ8MTXP01CC1ZG.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactgtaccagcagaagccaggccacggcccctgtcttggttatttataaagtactttgagacgccctcgacgggaccctgagcgtattctctcggctcgagtcctcgaacgaccgaacaaacgtacgtccacgttcgaccatcagtggactccgaggcaggagggacgaggtcagtacttattacgtgtacagtacagtaccagacagcgaggtcgctacttgtgtaacgttacgttcgggacggacggtaaacctaacgttcgaccgttccgtaagcaacggtcccaggcctcccgccccgttccg

SEQ ID NO: 393058 - DNA, 576 bp, Homo sapiens
  misc_feature: GZ8MTXP01DAIQU.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaaatatgcttactggtaccagcaagaagccaggccacggcccctgtcttggttaatttataaagtctttgagacggccctcgacgggacccctgagcgtattctcgtggcctcagtcctcaacggcgaacaaacgtagtacctaacggttacgaaccctatccgaaggttcgggacgtaccgagggccaaggacgggtacgaggtctagaacttattaacgtgtacgaagttcaatcaagacagcaaggtgactattagtgtaacgtagttcggacgggacgaacctaacgttcgacccgttcgtaacggtcaacggacccgagggccctcccgccccgttccgg

SEQ ID NO: 393059 - DNA, 703 bp, Homo sapiens
  misc_feature: GZ8MTXP01D01ZW.51.3.A03.1.454.CMB.2.raw
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcactgctcgtggagatgctattcgacaaagcaaatatgcttacgtggtaccagcagaagccgagccacggcccctgtcgtttaggtttaattaagtaaagtactttgaacggtacgccccgtcgaccgggaccctggagcgtacttctcgtcggctcgagcctacgaacgaccgaacaaacgagtaccgtaacgttacgaaccagtaccgaggttacggacgtaccgagggaccgaaagggaacgggacggacgggtacgtacggtaaccttaagttaacgtcgtaccgtaaggtactaacgtacgaacgaccgtaggacgtaaaggtccgggtaattaaccgtttaggttcggttaaccgggttacggtttacccgggggacggggttaaacgggaaaccccgtaaaaccggttaccggttaccccggttacccggtaacgggtccgaacccggtaacccgaacgggttccccgtccccggttaaccccccgtttcccgg

SEQ ID NO: 393060 - DNA, 655 bp, Homo sapiens
  misc_feature: GZ8MTXP01EWN8V.51.3.A03.1.454.CMB.2.raw
  modified_base (219)..(219): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtcgtcctcaggacaggacggccaggatcacctgctcgtgganatgctattcgaccaaagcaaatatgtcttacgtggtaccagcagaacgccaggccacggtcccctgtcgtttaggtttattaataaagtactttgagacgtcctacggaccggaccccgtgacgtcgtacttctcgtcgcctcagctcgaacgacgaacaacgtacgtctacgttacgacctagtaccgtaggtggtaaccgccggaaggacgaaggaaacgggaccgggaaggtcgtacgtaaacgtttaacgtaacgttcgggtacctaaggtaacctaataccgaaagtaaccgagacgttagggtcgtaacttaccgttaagttcgggtaacgtttacgggttacggggaccggaaacggggtaaacctaaacgttcgttacccgttacgttaacgccgaacgtaccgacggcctaacccgttcccgtccgg

SEQ ID NO: 393061 - DNA, 524 bp, Homo sapiens
  misc_feature: GZ8MTXP02H9QLS.51.3.A03.1.454.CMB.2.raw
  modified_base (214)..(214): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacgccaggatcacctgctctgganatgcattgccaaagcaatatgcttactggtaccagcagaagccagccaggcccctgtcttggttatttataaagtactttgagaggccctcgacgggacccctgagcgattctctcggctccagctcagcgacaaacagtcacgttgaccatcagtgagtccgaggcagaggacgaggctgactatactgtcagttcatcagacagcagtgacacttagtgtacgtagttcgggacgtacgggaaccaaaactcggtaacccgtcgtaacgggtcaacggcccgaaacggtcctccggtcccccgtccgg

SEQ ID NO: 393062 - DNA, 502 bp, Homo sapiens
  misc_feature: GZ8MTXP02HP9OW.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagaggccctcagggacccctgagcgattctctcggctccagctcagcgacaacagtcacgttgaccatcagtgagtccaggcagaggacgaggctgactattactgtcagtcatcagacagcagtgcacttatgtcgtagttcggcggtagggaaccaaacgtcgaccgtccgtaaggtcacgcccgaaggcctacgcccctcgg

SEQ ID NO: 393063 - DNA, 488 bp, Homo sapiens
  misc_feature: GZ8MTXP02IFRHU.51.3.A03.1.454.CMB.2.raw
  modified_base (424)..(424): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttattataaagactttgagaggccctcagggacccctgagcgattctctggctccagctcagcgcaacagtcacgttgacatcagtgagtcaggcagaggacgaggctgactattactgtcagtcatcagacagcagtggcacttangtcgtattcggcggagggaccaacgtcgaccgtcctaaggtcagcccaaggctacgcccctcgg

SEQ ID NO: 393064 - DNA, 540 bp, Homo sapiens
  misc_feature: GZ8MTXP02IAMN1.51.3.A03.1.454.CMB.2.raw
  modified_base (215)..(215): a, c, t, g, unknown or other
  modified_base (236)..(236): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgccaaagcaaatangcttactggtaccagcaagaagccgaggccaggcccctgtcttggttatttataaagtactttgagagccctcgacgggacccctgagcgtattctctcggctccagctcagccgacaaacagtcacgttgaccatcagtggacgtccgaggacagaggacgaggctagactattactgtcagtcatcgagacagcagtcggatacgttatcggttacgtagttcgggcggtaacgggaaccaaaacgtcgtacccgtacgtaacgggtacacggtacccgaacggcctaccgcccccgtacgg

SEQ ID NO: 393065 - DNA, 511 bp, Homo sapiens
  misc_feature: GZ8MTXP02IKP6G.51.3.A03.1.454.CMB.2.raw
tcagcgatcgtatacacgaccggtgctcgatttagagagcgtcacaggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagcaggcaggcccctgtcttggttattataaagactttgagaggccctcagggacccctgagcgattctctggctccagctcagcgacaacagtcacgttgaccatcagtggagtccaggcaagaggacgaggctgactattactgtcagtcatcagacagcagtgcatatgtcgtattcggcggtaagggaaccaaacgtacgaccgtacctaaagggtccaacggacccgaaaaggtcctacggacccccgtccgg

SEQ ID NO: 393066 - DNA, 698 bp, Homo sapiens
  misc_feature: GZ8MTXP02GPBXW.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgtcttactggtaccagacaagaacgccgacggccacggcccctgtctttaggtttatttaataaagtactttgacgacggtccctacgacgggacccctggacgcgtattctcgtcggtcctaccagtcctacgacgacaccgaaacgtacgtaccgtaccgttcgaacctagttccgaaaggttcgggaacgtcccgaaggggaccaaaggggtaacgggaccggtacgggtcttacggtaaaccttaagtttaaccgtgtaaccgtaggttacaaacgttcgaaagaccaaggccgtagggtacggtaccttaattttaacggtcggttaccggtttacggttaccgggggaaccgggttaaacggggaaaccctaaacggtaccggtacccgttaccggttaacggacccgaacggtacccccggaaggtcccgttaccccggcccccgtttaccggg

SEQ ID NO: 393067 - DNA, 530 bp, Homo sapiens
  misc_feature: GZ8MTXP02I2PP3.51.3.A03.1.454.CMB.2.raw
  modified_base (402)..(402): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagaggccctcgacgggacccctgacgcgattctctcggctccagctcagcgacaacagtcacgttgaccatcagtggatccaggcagagacgagctgatattacngtcagtcatcagacagcagtggctacgttatgtcgttagttcgggacgggtaacgggaaccaaacgttacgacccggttacgtaacgggtacacggtacccgaaggcccttacggaccccccgttcgg

SEQ ID NO: 393068 - DNA, 534 bp, Homo sapiens
  misc_feature: GZ8MTXP02IN7W3.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaaatatgcttactggtaccagcaagaagccaggccacggcccctgtcttggttatttataaagtactttgagacgcctcgacgggacccctgacgcgattctctcggctccagctcagcgacaaacagtacacgttcgaaccatacagttgaacgtcgagacgagaggacgagcagactatatgtcagtcatcagacagcagtcgactatatgtcgtacgttcgggacggtacgggaactaacgtacgaccgttaccgtaaggtaccgaacgacccgaaaggtccctccggtaccccgtccgg

SEQ ID NO: 393069 - DNA, 521 bp, Homo sapiens
  misc_feature: GZ8MTXP02GVH6W.51.3.A03.1.454.CMB.2.raw
  modified_base (391)..(391): a, c, t, g, unknown or other
  modified_base (408)..(408): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagaggccctcacgggacccctgagcgattctctggctccagctcagcgacaacagtcacgttgaccatcagtgagtccaggcagagacgaggcngactattactgtcagtnatcagacagcagtgcacttatgtcgtagttcgggacggaacgggaaccaaacgtacggacccgttacgtaacggtccaacgaccccgaaaggcctaccggaccccccgttcgg

SEQ ID NO: 393070 - DNA, 523 bp, Homo sapiens
  misc_feature: GZ8MTXP02IQAJJ.51.3.A03.1.454.CMB.2.raw
  modified_base (420)..(420): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttggtttatttataaagtctttgagacggccctcgacgggcccctgagcgatctctcggctccagctcagcgacaacacgtcacgttcgaccatcagtgagtccgaggcaggaggacgaggctgactattactgtcagtcatcanacagcagtggctacttatcgttacgtagttcgggacgggtaacggaacctaacgtcgaccgttaccgtaaggtcaacgcccaaaggccttaccgccccgtccg

SEQ ID NO: 393071 - DNA, 505 bp, Homo sapiens
  misc_feature: GZ8MTXP02FS99W.51.3.A03.1.454.CMB.2.raw
  modified_base (423)..(423): a, c, t, g, unknown or other
  modified_base (436)..(436): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagccaggccaggcccctgtctttggtttatttataaagtactttgagaggccctgacgggacccctgagcgattctctcggctccagctcacgcgacaacagtcacgttgaaccatcagtggatccgaggcagaggacgagctgacttatactgtcagtcatcagacngcagtgcattagngtcgtatcggcggtaggaccaaacgtcgaccgtcgtaaggtacacggacccgtaagcctcgcccctcgg

SEQ ID NO: 393072 - DNA, 544 bp, Homo sapiens
  misc_feature: GZ8MTXP02JQ5QV.51.3.A03.1.454.CMB.2.raw
  modified_base (406)..(406): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcgagggacccctgagcgtattctctcggctccagctcagcgacaacagtcacgttgaccatcagtgagtccaggcagaggacgaggcagactattatgtanagtcatacgaagacagcaggtggacctagttagtcgttacgttacggttcgggacgggaacgggaaaccgtaaacgtacggtaacccgtaccgttaacggacgaccgaccggaacggccgtcccggaccccgttccgg

SEQ ID NO: 393073 - DNA, 614 bp, Homo sapiens
  misc_feature: GZ8MTXP02HETOC.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcaagaacgccaggccacggcccctgtcgtttggtttaatttaataaagtactttgaagacggccctcgacgggtacccctgacgcgtattctcgtcggctccagctcagcgacaacagtacacgttacgaccatcgagtggacgtccgaggacaaggaggaacgacggctaggacttaacgttacgtcgtactacgttcaattaccaaggaacacgactagggtacggacctaatttaacgttgttacggttaacggtttccgggacgggtaaacggggaaaccctaaaacgtacggaacccgttaccgtaaggtaccgaaccgacccggaaaacggtccgtaccgtacccccggtttccgg

SEQ ID NO: 393074 - DNA, 598 bp, Homo sapiens
  misc_feature: GZ8MTXP02GJE1J.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttggttattaataaagtactttgagacggccctcgacgggacccctgacgcgtattcgtctcggcctcagctcagcacaacagtcctagttcaaccatcgagtggacgtccgaaggcgaaggaggacgaggtctagtacttattacgtgtactagtacatacgaagaaccaggacgtaggtacgggtactaacgtttagttacggttacggtttacggtttaccggggacggggtaaacggggaaacctaaaccgtaccggtaacccggttacgtaacggtcgaaccggacccgaacgggtcctcccggcccccgtttccgg

SEQ ID NO: 393075 - DNA, 512 bp, Homo sapiens
  misc_feature: GZ8MTXP02GSSXT.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagaggccctcgagggacccctgagcgattctctcggctcaagctcagcgacaaacagtcacgttgaaccatcagtgagtccaggcagaggacgaggctgactatactgtacagtcatcagacagcagtgctatatgtcgtattcgggcggagggaaccaaacgtcgtacccgacgtaaggtacaacgcccaagggcctccggcccccgttaccgg

SEQ ID NO: 393076 - DNA, 555 bp, Homo sapiens
  misc_feature: GZ8MTXP02I54Q9.51.3.A03.1.454.CMB.2.raw
  modified_base (369)..(369): a, c, t, g, unknown or other
  modified_base (421)..(421): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtacagcaagaagccaggccacggcccctgtctttggtttatttataaagtactttgagacggccctcgacgggacccctgacgcgtattctctcggctccagctcagcgacaacagtcacgttnacatcagtggagtccgaggcaagaggacgaggctagactattactgtcagtnatcgaagacagacgaggtcggactaactttagtgttacggttagtttacggggacgggaaacgggaccctaaaacgtcgtaacccgtacgttaacggccaacggacccgaaacggcctccggcccccttaccgg

SEQ ID NO: 393077 - DNA, 544 bp, Homo sapiens
  misc_feature: GZ8MTXP02JLQ3K.51.3.A03.1.454.CMB.2.raw
  modified_base (183)..(183): a, c, t, g, unknown or other
  modified_base (215)..(215): a, c, t, g, unknown or other
  modified_base (257)..(257): a, c, t, g, unknown or other
  modified_base (435)..(435): a, c, t, g, unknown or other
  modified_base (450)..(450): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctnaggacagacggccaggatcacctgctctgganatgcattgaccaaagcaatatgcttactggtaccagcagaanccaggccaggcccctgtctttggttatttataaagtctttgagacggccctcgacgggacccctgagcgtattcgtctcggcctccagctcagcacacagtcacgttgacatcagtgagtccgaggcaaggaggacgaggtcctagactattactgtacgagtcatcgaagacagacngtcggactacgttancgttcgtagttcgggacgggtacgggaacccaaacgtcggaacccgtaccgtaaggtaccgacgacccgaaaggccctccggacccccgttcgg

SEQ ID NO: 393078 - DNA, 511 bp, Homo sapiens
  misc_feature: GZ8MTXP02FYCJS.51.3.A03.1.454.CMB.2.raw
  modified_base (215)..(215): a, c, t, g, unknown or other
  modified_base (358)..(358): a, c, t, g, unknown or other
  modified_base (435)..(435): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgccaaagcaatatgcttactggtaccagcagaagccaggccaggcccctgtcttggtttatttataaagtactttgagacggccctcgacggggacccctgaacgcgattctctcggctccagctcagcgacaacngtcacgttgaccatcagtggagtccaggcagaggcaggctgactatactgtcagtcatacagacagcagtgctactntgtcgtagttcggcggaaggaccaaacgtcgaccgtacgtaacggtcacgtacccaaggtctccgccccgttacgg

SEQ ID NO: 393079 - DNA, 522 bp, Homo sapiens
  misc_feature: GZ8MTXP02GUSQV.51.3.A03.1.454.CMB.2.raw
  modified_base (402)..(402): a, c, t, g, unknown or other
  modified_base (434)..(434): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctcttgagatgcattgaccaaagcaaatatgcttactggtaccagcagaagccaggccaggcccctgtcttggttattataaagactttgagaggccctcacgggacccctgagcgattctctcggctccagctcagcgacaacagtcacgttgaccatcaagtgagtccagcagagacgagctgaactattacngtacagtcatacagacagcagtgactacttangtcgtagttcgggacggaagggtaacccaaacgtcgacccgttacgaaggtccgaacgccccgaaaggcctaccggcccccgttacgg

SEQ ID NO: 393080 - DNA, 536 bp, Homo sapiens
  misc_feature: GZ8MTXP02JLHPU.51.3.A03.1.454.CMB.2.raw
  modified_base (426)..(426): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttatggtaccagcagaagccaggccaggcccctgtcttggttatttataaagtactttgagaggccctcgaggggacccctgacgcgattctctcggctccagctcagcgacaacagtacacgttgaccatcagtgagtccaggcagagacgaggctgactattactgtacagtcatcagacagcagnggctacttatcgtacgtagttcgggacggtaacgggacctaaaacgtcgaacccgttccgtaacgggtccaacggaccccgaaaggtccgttaccggccccccttaccgg

SEQ ID NO: 393081 - DNA, 518 bp, Homo sapiens
  misc_feature: GZ8MTXP02FW8SE.51.3.A03.1.454.CMB.2.raw
  modified_base (413)..(413): a, c, t, g, unknown or other
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccacggccccctgtcttggtttatttaataaagtactttgagacggccctcacgggacccctggagcgattctctggctccagctcacgcgacaacagtcacgttgaaccatcagtgagtccaggcagaggacgaggctgactattacngtcagtcatcagacagcaggtgctacttatgtacgtagttcgggacgggaagggaccaaaacgttcgacccgtcgtaaggtcagcccaaggctccgccccttcgg

SEQ ID NO: 393082 - DNA, 496 bp, Homo sapiens
  misc_feature: GZ8MTXP02JMZE4.51.3.A03.1.454.CMB.2.raw
  modified_base (429)..(429): a, c, t, g, unknown or other
  modified_base (441)..(441): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaaagccaggccaggcccctgtcttggttatttataaagactttgagaggcctcagggacccctgagcgattctctggctccagctcagcgacaacagtcacgttgaccatcagtgagtccaggcagaggacgaggctagactattactgtcagtcatcagacagcagtgcattangtcgtattcggnggacgggacaaacgtcgaccgtcaaggtccagcccgaaggtcctcgccccctcgg

SEQ ID NO: 393083 - DNA, 584 bp, Homo sapiens
  misc_feature: GZ8MTXP02HC5K4.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgctattcgaccaaagcaatatgtcttactggtaccagcaagaacgccaggccacggcccctgtctttaggtttaatttaagtaaacgtactttaggaaggtacggtcccgtacgaccgggtacccctggacgcgtattctcgtcggcctccgagctacgacgacgacaaactagtacctacgttacgaactatcgaagtggacgtccgaggacgaaggacggacgagctagacttatactgtacagtacatcaagacagcgagtcgacctaagttgcggttcgtaacggttcgggacgaaacggggaacctaaacgtcgtacccgtacgtaaggacacgacccggaagcctcccggaccccgttcgg

SEQ ID NO: 393084 - DNA, 544 bp, Homo sapiens
  misc_feature: GZ8MTXP02HUDWD.51.3.A03.1.454.CMB.2.raw
  modified_base (207)..(207): a, c, t, g, unknown or other
  modified_base (417)..(417): a, c, t, g, unknown or other
tcagcgatcgtatacacgaccggtgctcgatttagagagcgtcacagggggtgggtccaggagacagaactctgggtgtctcaccatggcctggatccctctacttctccccctcctcactctctgcacaggctctgaggcctcctatgagctgacacagccaccctggtgtctgtgtcctcaggacagacggcaggatcactgctntggagatgcattgaccaaagcaatatgcttactggtaccagcagaagccaggccaggccctgtcttggttatttataaagtactttagagacggccctcgacgggacccctggacgcgtattctctcggctccagctcagcgacaactacgtacacgttcgacatcagtggacgtccgaggcaagaggacgagtcaggactattactgtnagtcatcaagacagacagtggactaagttatcggttacgtacgttcgggacgggaaggtaaaccaaacgtcgaacccgttacgaaggtccgaacggtacccaagggtcctccggtacccccgttcgg

SEQ ID NO: 393085 - DNA, 476 bp, Homo sapiens
  misc_feature: GZ8MTXP02ILCHI.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaaagcaaatatgcttactggtaccagcagaagcagcaggccctgtctgtattataaagctttgagaggcctcagggacccctgagcgattctctggctccagctcagcgacaacagtcacgttgaccatcagtgagtcagcaagagacgaggctgactattactgtcagtcatcaagacagcagtggctactatgtcgtattcggcggaggacaaacacgacgtctaaggtcacgccaagctacgccctcg

SEQ ID NO: 393086 - DNA, 533 bp, Homo sapiens
  misc_feature: GZ8MTXP02GLHEC.51.3.A03.1.454.CMB.2.raw
  modified_base (438)..(438): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtctttggtttatttataaagtactttgagacggccctcacgggacccctgagcgattctctcggctccagctcagcgacaacagtcacgttgaccatcagtggaagtccgaggcagaggacgaggctgactattactgtcagtcatcagacagcagtgctagttangtacgtagttcgggcggtaacggaaccaacgtcggacccgttaccgtaagggtaccaacggccccgaaacgggtcctcccggtcccccgttccgg

SEQ ID NO: 393087 - DNA, 507 bp, Homo sapiens
  misc_feature: GZ8MTXP02HNJW8.51.3.A03.1.454.CMB.2.raw
  modified_base (412)..(412): a, c, t, g, unknown or other
  modified_base (415)..(415): a, c, t, g, unknown or other
  modified_base (432)..(432): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggaccaggcccctgtctttggttatttataaagtactttagagacggccctcgacgggacccctgagcgattctctcggctcagctcagcgacaacagtcacgttgacatcagtggagtcaggcagagacgaggctgactatactgtcagtnatnagacagcagtgacattnagtcgtagttcgggacgggaggtaaccaacgtcgaccgtcgtaacggtcacgtccgaaggcctcgcccccttcgg

SEQ ID NO: 393088 - DNA, 537 bp, Homo sapiens
  misc_feature: GZ8MTXP02G03BL.51.3.A03.1.454.CMB.2.raw
  modified_base (361)..(361): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccacggcccctgtcttggttattataaagtactttgagaggccctcgacgggacccctggacgcgtattctctcggcctccagctcgacgcgacaacngtcacgttgacatcagtgagtccaggcagaggacgaggctagactattactgtactagtcatcagacagcaggtgactactttagtcgttacgtagttcgggacgggtaacggaacctaaaacgtcgacccgttcgtaacggtcacggcccgaacggcctccggcccccgtttcgg

SEQ ID NO: 393089 - DNA, 539 bp, Homo sapiens
  misc_feature: GZ8MTXP02JKYFQ.51.3.A03.1.454.CMB.2.raw
  modified_base (419)..(419): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggagatgcattgaccaaagcaaatatgcttactggtaccagcagaagccaggccacggcccctgtctttggttatttataaagtctttgagacggccctcgacgggacccctgacgcgtattctctcggctccagctcgagcgacaacacgtacacgttcgaaccatcaagtgagtccgaggcaggaggacgagctagacttattacngtacagtcatcagacagacaggtcgactacttagtggtcgtagtcgggacggtaacgggaacctaaacgtcggtaccgtcgtaaggccaacgaccgaacggtccgtcccgccccgtacgg

SEQ ID NO: 393090 - DNA, 542 bp, Homo sapiens
  misc_feature: GZ8MTXP02JLZ3X.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttattataaagtactttgagacggccctcgacgggacccctgagcgattctctcggctccagctcacgcgacaacagtcacgttgaccatcagtgagtccgaggcagaggacgaggctagactattactgtcagtcatcaagacagacagtcggactacgttagtcgtacgtagttccgggacggaacgggaacctaaacgtcggaaccgtaccgtaaggtaccaacggacccgaaacggtcctcccggtacccccgttccgg

SEQ ID NO: 393091 - DNA, 514 bp, Homo sapiens
  misc_feature: GZ8MTXP02JM00F.51.3.A03.1.454.CMB.2.raw
  modified_base (362)..(362): a, c, t, g, unknown or other
  modified_base (428)..(428): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaacgccaggccacggccccctgtctttggtttatttataaagtactttgagacggccctcgacgggacccctgagcgtattctctcggctccagctcagcgacaacngtcacgttgaccatcagtgacgtcaggcagagacgagctgactattactgtacagttcatcgaganagcaggtgactacgttatgtacgtagttcgggacggtaggaacccaaacgtcgaccgtcaaggtcacgccaagcctcgccctccgg

SEQ ID NO: 393092 - DNA, 562 bp, Homo sapiens
  misc_feature: GZ8MTXP02ITWDD.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacaggacggccaggatcacctgctcgtggagatgcattgaccaaagcaatatgcttactggtaccagcagaagccagccacggcccctgtcttggttattataaagtactttgagaggccctcgacgggacccctgacgcgtatcgtctggcctccagctcagcgacaacagtcacgttgaccatcagtggatccgaggcagagacgaggctgacttatactgtcagtcaactgacgacgagtacgagttcggcctaaagttgtcgttacggtacgttccggggacgggtacggggaaaccctaaaacgtacgacccggttaccgtaacggtccgaacggaccccgaaggtcccgttccggaacccccgtttccgg

SEQ ID NO: 393093 - DNA, 548 bp, Homo sapiens
  misc_feature: GZ8MTXP02JFS9Q.51.3.A03.1.454.CMB.2.raw
  modified_base (378)..(378): a, c, t, g, unknown or other
  modified_base (433)..(433): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgccaggccacggcccctgtctttggttatttataaagtactttgagacggccctcgacgggtacccctgacgcgattctcgtcggctccagtcctcacgcacaacagtcacgttcgactancagtgacgtccgaggcaggacgacgagctagactattacgtgtcagtcatcgaanacgagcagtggacctatttagcgttacgtacgttccgggacggaacgggaaccaacgtcggaacccgtaccgtaaggtccaacggtacccgaaggccttaccggaccccgttcgg

SEQ ID NO: 393094 - DNA, 646 bp, Homo sapiens
  misc_feature: GZ8MTXP02JWKZ7.51.3.A03.1.454.CMB.2.raw
  modified_base (215)..(215): a, c, t, g, unknown or other
  modified_base (355)..(355): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaatatgcttactggtaccagcaagaagccaggccaggcccctgtcttggttattataaagtactttgagaggcctcgagggacccctgagcgtattctcgtcggctccagctcgagcgacaacngtcacgttcgaccatcagtgacgtaccgaggcaagacggtacggaggtcgtagacttaagttaaccgtggtaccaggttaccaattaccgaaggaaccaggacgaaaggttcgggactaaccgtttaagtcggtttaccggttaaacggtttccgggggaacggggtaaacggggaaacccgtaaaaaccggttcgggtaaaccccgtttacccggtaacggggttacccgtaaaccggacccccgggtaaaagggccccgtttcccgggaacccccccgtttacccgggg

SEQ ID NO: 393095 - DNA, 577 bp, Homo sapiens
  misc_feature: GZ8MTXP02IBNZ1.51.3.A03.1.454.CMB.2.raw
  modified_base (447)..(447): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcaagaagccaggccacggcccctgtctttggtttatttaagtaaagtactttgagacggccctacgacgggacccctgagcgtattctcgtcggctccagctcagcgacaaactagtcctacgttcgaacccattccgagtaggacgtccgaggacgagagggacgaggactagacttattaccgtgtccagttanatcgaagacagcaggtggcctagttatgttcgtagttcggggacgtacgggaaacctaaacgtcggtaacccttcggtaacggtccgaaacggtaccccgaaagggtccctacggtaccccccgttcggg

SEQ ID NO: 393096 - DNA, 505 bp, Homo sapiens
  misc_feature: GZ8MTXP02JWFOD.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaaagcaatatgcttactggtaccagcagaagccaggccaggcccctgtctttggttatttataaagactttgagaggccctcgagggacccctgagcgattctctggctcagctcagcgacaacagtcacgttgaccatcagtggatccgaggcagaggacgaggctgactattactgtcagtcatcagacagcagtgcactttatgtcgtagtcgggacggagggaaccaaactcgacccgttctaaggtcacgccccaaggcctcggcccccttcgg

SEQ ID NO: 393097 - DNA, 600 bp, Homo sapiens
  misc_feature: GZ8MTXP02H4488.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcaagagccaggccacggcccctgtctttggtttatttataaagtactttgagaggtccctcgacgggacccctgacgtcgattcgtctcggctccagctcagcgacaactacgtacctacgttcgacctatcaggtgacgtaccgaggaaacgaggacggacgtacggctggaacttattacgtcgtacacgttcatcaagaccgagcgagtggacttacgttaagtggttacgtagttccggggacgggtaaaccggggtaacccaaaacgtccggtaacccgttccggtaaacggtcccgaacggtaccccccgaaagggtccctacccggtacccccctttccggg

SEQ ID NO: 393098 - DNA, 510 bp, Homo sapiens
  misc_feature: GZ8MTXP02HQNTD.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgccaaagcaatatgcttactggtaccagcagaagcaggccaggcccctgtcttggtttatttataaagtactttgagaggccctcgacgggtacccctgagcgtattctctcggctccagctcagctacaacagtcacgttgaccatcaagtggagtccgaggcagaggacgaggctagactattactgtcagtcatcagacagcagtggctactatgtcgtagttcggacggagggaccaacgtcgaaccgtcctaagggtcacgcccaaggcctcgtccccctcgg

SEQ ID NO: 393099 - DNA, 553 bp, Homo sapiens
  misc_feature: GZ8MTXP02F5I2U.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagagccagccacggcccctgtctttggtttatttataaagtactttagagacggtccctacgacgggacccctgacgcgtattctctcggcctcgagctcagacgacaacacgtactacgttcgaacctatcagtggactaccgaggcgaaggaggacgaggctagacttattactgtacagttcatacaagacagcgaaggtcgactacgttagtcgtacgtagttccgggacggtaacggaacctaaacgtcgaccgtacgtaacggtacacgtacccgagtcctaccggcccctacgg

SEQ ID NO: 393100 - DNA, 516 bp, Homo sapiens
  misc_feature: GZ8MTXP02GQW4N.51.3.A03.1.454.CMB.2.raw
  modified_base (394)..(394): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccaggcccctgtcttggttatttataaagtactttgagaggccctcgacgggacccctgagcgtattctctcggctcagctcagcgacaacagtcacgttgaccatcagtgatccgagcagagacgaggcngactagtactgtcagtcatcagacagcagtgctacttatgtcgtagttcgggacggtacgggaacctaaaacgtcgacccgttcgtaaggtcacgacccgaaggctaccggcccccgttcgg

SEQ ID NO: 393101 - DNA, 541 bp, Homo sapiens
  misc_feature: GZ8MTXP02ISNXK.51.3.A03.1.454.CMB.2.raw
  modified_base (476)..(476): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcaagaagccaggccacggcccctgtcttaggtttattataaagtactttgagaggccctcgacgggacccctgacgcgattctctcggctccagtcctcagccgacaacgacgtaccgacgttcgaaccattaccaggtggaacgtccagggacaggagacggaggtctagactattatgtacagtcatcagacagcagtggctaattgtgtacgtagttccggngggtaacggaccaaacgtcgaccgttcgaaggtaccacggacccaaggtcctcgtccccgtccgg

SEQ ID NO: 393102 - DNA, 499 bp, Homo sapiens
  misc_feature: GZ8MTXP02IR5OL.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttattataaagactttgagaggccctcacgggacccctgagcgattctctcggctccagctcagcgacaacagtcacgttgaccatcagtgagtccaggcagaggacgagctgactatactgtcagtcatcagacagcagtcgcacttatgtcgtattcgggcggacgggaaccaaacgtcgaccgtctaaggtcacgacccaaggcctacgccccctcgg

SEQ ID NO: 393103 - DNA, 606 bp, Homo sapiens
  misc_feature: GZ8MTXP02JHBMI.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgctattgaccaaagcaatatgcttactggtaccagcagagccgaggccacggcccctgtcttggtttattataaagtctttagagacgcctcgacgggacccctgacgcgtattcgtctcggcctccgagcctcacgacgacaacgacggttcacggtttacgaacctatcgaagtaggacgttcccgaaggcgaaggacggacgaagggctagacttattacgtgtacagtcataccaagaccagacgaggtcggactacgttatcggtacgttacgttccgggaaccgggaacgggtaaacctaaaaccgtcggtaaacccggttaccgtaacgggttaccaacggtaccccggaaacggtccgtccccggtacccccgtttaccgg

SEQ ID NO: 393104 - DNA, 493 bp, Homo sapiens
  misc_feature: GZ8MTXP02GYZOL.51.3.A03.1.454.CMB.2.raw
  modified_base (378)..(378): a, c, t, g, unknown or other
  modified_base (389)..(389): a, c, t, g, unknown or other
  modified_base (399)..(399): a, c, t, g, unknown or other
  modified_base (401)..(401): a, c, t, g, unknown or other
  modified_base (403)..(404): a, c, t, g, unknown or other
  modified_base (406)..(406): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (419)..(419): a, c, t, g, unknown or other
  modified_base (421)..(421): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttaactggtaccagcagaaagccaggcaggcccctgtcttggtatttataaagactttgagaggccctcagggaacccctgagcgattctctggctccagctcagcgcaaacagtcacgttgaccatcagtgagccagnagagagaggcngacataactntnannanananananagagngnatatgtcgtagtacggacggaggaacgaaacgacgacgtacgtaacgtacgacgacgacgcgcgcccgtccg

SEQ ID NO: 393105 - DNA, 553 bp, Homo sapiens
  misc_feature: GZ8MTXP02I85BI.51.3.A03.1.454.CMB.2.raw
  modified_base (215)..(215): a, c, t, g, unknown or other
  modified_base (257)..(257): a, c, t, g, unknown or other
  modified_base (430)..(430): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgccaaagcaaatatgcttactggtaccagcagaanccaggccacggcccctgtcttggtttattataaagatttgagaggcccctcgacgggacccctgagcgtattctctcggcctccagtcctcgacgcgaccaacacgtcacgttgaacctatcagtggacgtccgaggcagagacgaggctagactattacgtgtacagtctanacagacagacgagtgaccagttagtcgttacgtacgttacgggacggaaggggaaacctaaacgtcgaacccggttaccgtaaggtccaacggacccgaaggccgtcccgtacccccgttcgg

SEQ ID NO: 393106 - DNA, 564 bp, Homo sapiens
  misc_feature: GZ8MTXP02FNFOM.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctctggagatgcattgaccaaagcaaatatgcttactggtacagcagaagccagccacgcccctgtcttgtttattataagtacttgagacgccctcgacgggaccctgacgcgtattcgtctcggtctccagctcacgacgacaacagtactacgttcgaaccatcgaggtgacgtccgaggacgagacggacgaggctagactagttactgtacagtcatacgagaacagacaggtacgcttaattagtcggttacgttacggtccggggtacggaaacggtaaccgaaaacgtcgtacccgttacgtaacgggtaccacggacccgaacggtccgtccccggccccttaccgg

SEQ ID NO: 393107 - DNA, 514 bp, Homo sapiens
  misc_feature: GZ8MTXP02I94YP.51.3.A03.1.454.CMB.2.raw
  modified_base (444)..(444): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaagccaggccaggcccctgtctttggttattataaagtactttgagaggccctgacgggacccctgacgcgtattctctcggcctccagctcagcgacaacagtcacgttgaccatcagtggatccgaggcaggacggacgaggctgactattactgtacagtcatcaagacagcaaggtgctacttangtacgtagttcgggacggaggacacaaaacgtgaaccgtcgtaggacacgccaaggccctacgtcccccg

SEQ ID NO: 393108 - DNA, 544 bp, Homo sapiens
  misc_feature: GZ8MTXP02JXT31.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagtactttgagacggccctcgagggacccctgagcgtattcctctcggctccagctcagcgacaacagtcacgttgaccatcagtggagtcccgaggcagaggacgaggctgactatactgtcagtcatcagacagcgagtcggctactttagtcggttcgtagttcggggacggacggggaaccctaaaacgtcgaaccccggttctaacggggtcaacggtaccccgaaaggtccgtccggcccccgttccggg

SEQ ID NO: 393109 - DNA, 577 bp, Homo sapiens
  misc_feature: GZ8MTXP02GAWBL.51.3.A03.1.454.CMB.2.raw
  modified_base (439)..(439): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcaagaagccgaggccacggcccctgtctttaggtttaatttataaagtactttgagacggccctcgacgggacccctgacgcgtattctctcggcctccagctcacgcgacaacgagtctacgttcgaaccagtcagtggactcgaggcaaggaggacgaggctagtactattactgtacacgttanatacgagacgagacgtagtcggactaacgttagtgttacgttacggttacgggacgggaaacggaacctaaacgttcggaacccgttacgtaacggtaccacggacccgaacggtcccgtccggtacccccgtttcgg

SEQ ID NO: 393110 - DNA, 503 bp, Homo sapiens
  misc_feature: GZ8MTXP02JJFK7.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcacgggacccctgagcgattctctcggctccagctcagcacaacagtcacgtgaccatcagtgagtccaggcagagacgaggctgactattactgtcagtcatcagacagcagtgcacttatgtcgtagttcggacgggaggaccaaacgtcgacccgtaccgtaaggtacacgacccgaaggcctccgccccctcgg

SEQ ID NO: 393111 - DNA, 542 bp, Homo sapiens
  misc_feature: GZ8MTXP02IVT2P.51.3.A03.1.454.CMB.2.raw
  modified_base (216)..(216): a, c, t, g, unknown or other
  modified_base (334)..(334): a, c, t, g, unknown or other
  modified_base (436)..(436): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctctgganatgcattgccaaagcaatatgcttactggtaccagcagaagccacggccacggccctgtctttggtttatttataagtacttgagaggcctccaggggacccccttgcgcgattctcncggctccagctcagcgcaacagtcacgttgacatcagtgagtccaggcgagaggacgaggctgactagttactgttacagtcaatcagacagcgagtggacncttaagtgtacggtagttcgggacggacgggaccctaaaacgtcgacccggtaccgtaacggtaccgacggaccccgtaaacggcccgtcggaccccccgttccgg

SEQ ID NO: 393112 - DNA, 571 bp, Homo sapiens
  misc_feature: GZ8MTXP02GJ6YV.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcaagaagccgaggccacggcccctgtcttggtttattataaagtctttgagacgcctcgacgggaccctgagctattctcgtcggcctccgagtcctacgacgaccgacaacacggtcctaacgttcgaaccctataccgaggtggtaaccgtcccgaaggacgaaggaacggaccgaaggcgtacgaaaccgttattaccgtgtacagtcataccgagacacgcgtagtggacctattagtggtacgtacggttcggacggtacggaaacctaacgtcgtaccgtacgaagtcacgtaccaggcctcggtacccctcgg

SEQ ID NO: 393113 - DNA, 510 bp, Homo sapiens
  misc_feature: GZ8MTXP02IZ2M0.51.3.A03.1.454.CMB.2.raw
  modified_base (356)..(356): a, c, t, g, unknown or other
  modified_base (410)..(410): a, c, t, g, unknown or other
  modified_base (427)..(427): a, c, t, g, unknown or other
  modified_base (440)..(440): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagccaggccaggcccctgtcttggttattataaagtctttagagacggccctcgacgggacccctgacgcgtattctcgtgcctccagctcagcgacaacngtccagttcgaccatcagtggagtccaggcagaggactaggctgactattacgngtcagtcatacagaacngcagcgctagttntcgtacgtagtcggacggacgaaccacgtcgtaccgtacgtaacgcacgaccgaggtcctccgcccgtcg

SEQ ID NO: 393114 - DNA, 551 bp, Homo sapiens
  misc_feature: GZ8MTXP02JLQTM.51.3.A03.1.454.CMB.2.raw
  modified_base (215)..(215): a, c, t, g, unknown or other
  modified_base (419)..(419): a, c, t, g, unknown or other
  modified_base (454)..(454): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaaatatgcttactggtaccagcaagaagccaggccacggcccctgtctttggtttatttataaagtactttgagacggccctcgacgggacccctgacgcgtattctctcggcctccagctcagcacaacacgtcacgttgaccatcagtgacgtccgaggcagacggacgaggactgactattacgngtacagtcatcagaacagcgtagtcgctaacgttntacgttcgtaagttccgggacgggtaacggaaccgtaaacgtcggtacccgttacgtaacggtccacggacccgaggtccgtcccgtaccccgtcgg

SEQ ID NO: 393115 - DNA, 602 bp, Homo sapiens
  misc_feature: GZ8MTXP02GRGWN.51.3.A03.1.454.CMB.2.raw
  modified_base (260)..(260): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcaagaacnccgaggccacggcccctgtctttggtttaatttaataaagtactttgagacggccctcgacgggacccctgacgcgtattctcgtcggcctaccagcctacgacgacgaccaacacgtacgaacgttcgaaccatcgagtgacgaccgaggcaaggaggacgaggctacgactattacgtgtacagtcaattacgaagaacgagacgtaggtacggaccttaacgtttaagtcggttacgttacggttcggggacggtaaacggggaaacctaaacgtacggtacccgttaccgtaaggtccgaacgacccgaaacggtccgtcccggtcccccgttaccgg

SEQ ID NO: 393116 - DNA, 599 bp, Homo sapiens
  misc_feature: GZ8MTXP02HOGIS.51.3.A03.1.454.CMB.2.raw
  modified_base (215)..(215): a, c, t, g, unknown or other
  modified_base (244)..(244): a, c, t, g, unknown or other
  modified_base (329)..(329): a, c, t, g, unknown or other
  modified_base (436)..(436): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaaatatgcttacnggtaccagcagaagccaggccaggcccctgtctttggttatttataaagtactttgagagccctcacgggcccctgagcgattcnctcggctccagctcacgcgacaacagtacaccgttagacccattaccagttggacgtacccagggccaaggagggaaccgaggctagactaagttactagtcaggtnatacgaagacagctaaggtcgggactacgtttaagtcggttacgtttacggtttccgggacgggaaacgggggtaaaccctaaacggttacggaaacccgttccggtaacggtaccgaacggaccccgaaaagggtccctaccggtaccccccgtttcccggg

SEQ ID NO: 393117 - DNA, 663 bp, Homo sapiens
  misc_feature: GZ8MTXP02GS2LF.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgctattgaccaaagcaatatgtacttacgtcggtaccagacaagaacgccgaggcccacggcccctgttcgtttaggtttaatttaagtaaagtacgtttagagtacggccctcgacgggtacccctgacgcgtattcctcgtcgcctccagtctacacgacgacaacgtagtactacgttacgaacctatccgaaggttggacgtccgaagggacgaaggaggacgagtcgtagtacttaacgttacgtagtacgtacgtaactacgtacgaaacgtaacgaccgtaggtacggttaacgtacgtttaaacgtttggttaccggttaacggttaaccggggttacggggaaccggtaaacggtaaacctaacggtacccgtaccggttaacgtaaccggaacgaccgaaaccggtccgtacccgttcccggtacccgttacccgg

SEQ ID NO: 393118 - DNA, 673 bp, Homo sapiens
  misc_feature: GZ8MTXP02HBC4V.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctggagatgcattgaccaaagcaatatgtcttactggtaccagcagagccagccacggcccctgtctttaggtttatttaataaagtacttagagacggtccctcgaccgggaccctagacgacgtatctctcggctaccagctcacgcgtacaacgtagtactacgttcgaacctatacgaagtcggacgtaccgagggacgaggacgggtacggaaggtcgtacgtaacttacgttactgtacctaggtacataccgaagaccgagaccgtacgggtaggtaccctaagtttaagtcggtttaccggttacggtttaccgggggacggggttaaaaccggggaaaacccttaaccggttaacccgggaacccccgtttaccggtaaacgggggttaacccaacccggggtacccccgaaaacgggtcccccgtttaaccccgggcccccccgtttaacccggg

SEQ ID NO: 393119 - DNA, 559 bp, Homo sapiens
  misc_feature: GZ8MTXP02GI9J1.51.3.A03.1.454.CMB.2.raw
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatccacctgctcgtggagatgctattgaccaaagcaaatatgcttactggtaaccagcaagaacgccaggccacggcccctgttctttaggtttaactttagtaaagtactttagagacggccctacgacgggacccctgacgcgtattctcgtcggctccgagcctcgacgacgacaaacagtccacgttcgaacatacaggtcgaacgtcccgaaggcgaaggacggacgtagggctaggtaacttattacgtgttacagttacatacgagaccagtcaggtcgactactagtgttcgtagtcggaggtacggactaacgtcgaccgtcgaagtcacgcctagtccgcccgtagtcc

SEQ ID NO: 393120 - DNA, 741 bp, Homo sapiens
  misc_feature: GZ8MTXP02F57I5.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctctggagatgcattgaccaaagcaaatatgcttactggtaccagcagagcagccacggcccctgtgttggtgatgtataaagacactgagacggccctgagggactcctagagccgtacttcctcgtcggtctacccgagggtccgaaggggaaccaaaccgggtaccaacgtacgtttcgggacctacttccgaaggtgggtaacgtacccggaaggggacgaacgggaaggggaacccgggagggtaccgtaggttaaacctttaaagtttaagtttacggttaacctaaaacttacggaaaacctaacggaaaccctaaccctaaggtttttaaccgggttaaattttacgttacggtttaccgtttaaccggggtaaacgttcggtaacccggtaaacccggtaaaaccgggttacccgtaaacccccgggttcccggttacgggggttaaccccgaacccggtaacccccgaaaacccggggttaccccctaaaaacccccccgaccggtttaccgtttaacccccg

SEQ ID NO: 393121 - DNA, 725 bp, Homo sapiens
  misc_feature: GZ8MTXP02GRJG8.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctggagatgctattgaccaaagcaatatgcttacgtgtaccagacagacgccgacggccacggcccctgttcgtttaggtttaatttaagtaaagttcgtttaggaaggtacgtcccgtacggaccgggtaccctgacgcgtacttccgtcgtccggtcctaccgagtcctacgacgacgacgaactacgtacctacgttaccgaacctagtaccgtaaggtacggaccgtaccgaaggacgaaaggggacggaacggaggtactacggtaacttacgtttacgtcgtacgagtacataccgaaagaccgagtaccgtaaggtacgaccttaaacggtttagttaccgggttacggtttaaccgggttaccgggggaaacgggggtaaaccgggtaaaccctttaaaaccgggtacccgggttaacccggtttaaccggtaacgggttaacccgaacccgggtaaccccggtaacgggtttcccccgtaaccccggggttccccccgtttaaccggg

SEQ ID NO: 393122 - DNA, 557 bp, Homo sapiens
  misc_feature: GZ8MTXP02I7864.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctgganatgcattgaccaaagcaatatgcttactggtaccagcagaagccaggccacggcccctgtcttggttattagtaaagtactttgagacggccctcgacgggacccctgagcgtattctctcggcctcagctcagcgacacagtcacgttgaccatcagtgacgtcgaggcagaggacgagctagacttattacgtgtacagttcataccaagaccgaagcgaaggtcgactacttagtcgtacgttaagttccgggacgggtaaacggaacctaaacgtcgtaacccggtacgtaacgggtaccacggtacccgaacggtcctacccggtcccccgttccgg

SEQ ID NO: 393123 - DNA, 593 bp, Homo sapiens
  misc_feature: GZ8MTXP02INXSB.51.3.A03.1.454.CMB.2.raw
  modified_base (246)..(246): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctatgtcctcaggacagacggccaggatcacctgctctggagatgcattgaccaaagcaaatatgtcttacgnggtaccagcaaggaacgccgacggccacggcccctgtcgtttaggttaatttaagtaaagtactttagagtacggtcccctacgacggggacccctggacgtcgtacttctcgtacggtcctccgagtcctacgacggacgaccaaacgcgtacctacgttcgaaccattcgagtggacgtccgaggcaaggaggtacgaggctagacttattactgtacagtcatacagacagacaggtcgactagttagtgtacgtacgttcgggaacggacgggaaccaaacgtccggtaccgtaccgttaacggccgaacggacccgaaggcccgtacccgtcccccgtacgg

SEQ ID NO: 393124 - DNA, 595 bp, Homo sapiens
  misc_feature: GZ8MTXP02GA61S.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtacagcaagaacgccaaggccgacggcccctgttcttaggtttatttagtaaagtctttagaggacggccctacgacgggacccctggacgcgtattctcgtcggtcctccgagcctacagacgacaacgacgtcacgttgaccatcgagtggacgtccgaggcaaggaggacgaggtctacgtactagttaatcggtacagttacagtacaacgacagacgtaggtcggactaacgttgtacggtttcgtaaccggtttggggaaccggtaaacggggaaccctaaacggtacgtacccgtacgtaacggtaccacggacccgaggtccctaccgtcccccggtttacg

SEQ ID NO: 393125 - DNA, 625 bp, Homo sapiens
  misc_feature: GZ8MTXP02HXHZN.51.3.A03.1.454.CMB.2.raw
  modified_base (360)..(360): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgctattgaccaaagcaatatgtcttacgtggtaccagacaagaacgccgacggccacggtccccctgtcgtttggtttaatttaataaagtactttgagacggccctacgacggaccctgagcgtattctctcggcctaccgngtcctcacgacacaaacgtacgtacctacgttacgacctattaccgagggttcggaacgtcccgagggacgaagggacgggaccggaggcctaggtacttattaccgtgtaccgtagtacatacgaacgacgacggactaaggtcggaccttagtttaagtcgttacggttacggttacggggacggtaaccgggaaacctaaacgtcgtaacccgtacgtaacggtacacggtaccgtaacggtcctacccggtacccttccgg

SEQ ID NO: 393126 - DNA, 749 bp, Homo sapiens
  misc_feature: GZ8MTXP02F1NYP.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctcgtggagatgcattcgaccaaagcaaatatgtcttacgtggtaaccagcaagaacgccgacggccacggcccctgttcgtttggtttaatttaataaagtactttagagacgtcccctgaccgggaccctgagcgtacttcgtctccggctccgagtctacacgacacaaacgtacgtacgtaacgttcgaaacctattacgaacggggttacgggtaaccgtacccgaagggccaaaagggaacgggggaccggaaacgggggcccttagggtaaaacccttaagtttaaccggttcggtaaacttaaccggtacctaagttaaccggaacgtaaaacccgaggaccggtaaagggttacggaacccttaaagttttaagtacggtttaacggttaacggtttaccgggggaacgggggaaaccggtaaaaccgtaaaaccgttaccggacccggtttaaacccggttaaggtaaccccgaacggtaaaacccccggaacggtacccggttcccccggtccccccggtttaacccggg

SEQ ID NO: 393127 - DNA, 560 bp, Homo sapiens
  misc_feature: GZ8MTXP02FRCFM.51.3.A03.1.454.CMB.2.raw
  modified_base (406)..(406): a, c, t, g, unknown or other
  modified_base (411)..(411): a, c, t, g, unknown or other
tcagcgatcgtatacacgaccggtgctcgatttagagagcgtcacagggggtgggtccaggaggcagaactctgggtgtctcaccatggcctggatccctctacttctcccctcctcactctctgcactggctctgaggcctcctatgagctgacacagccaccctggtgtctgtgtcctcaggacagacggccaggatcacctgctctggagatgcattgaccaaagcaatatgcttactggtaccagcagaagccaggccaggcccctgtcttggttattataaagactttgagtacggccctacgagggacccctggagcgtattcgtctggcctccagtctcagcacaacgagtcacgtgacatcagtgatccagcagagtcgagctgactattacgtgtanacgtnatacgagaccagactaggtcgggctaacgttacgtcgttacggttagttccgggacgggtaacggggtacctaaaacgttccgaaccggttaccgtaaggtccgtaacggcccccgtaaaaggtcccgtaccggtcccccgtttacggg

SEQ ID NO: 393128 - DNA, 540 bp, Homo sapiens
  misc_feature: GZ8MTXP02JM05T.51.3.A03.1.454.CMB.2.raw
  modified_base (398)..(398): a, c, t, g, unknown or other
  modified_base (412)..(412): a, c, t, g, unknown or other
  modified_base (449)..(449): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccacggcccctgtcttggtttatttataaagtactttgagacggtccctcgacgggacccctgacgcgtattctctcggcctccagctcagcgacaacagtcacgttgacatcagtgactccgaggcaggagacgnggctgactattacngtacagttcatcaagaccgagcagtggctaacgttancggttacgtacgttcgggacgggaacgggaacctaaacgtcgacccgtacgtaacggcacggaccgtaacggcctccggcccccgttacgg

SEQ ID NO: 393129 - DNA, 572 bp, Homo sapiens
  misc_feature: GZ8MTXP02I4TMP.51.3.A03.1.454.CMB.2.raw
  modified_base (258)..(258): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctcgtggagatgcattcgaccaaagcaaatatgcttactggtacagcagancagccagcccctgtcttggttattataaagtacttgagcgcctcgacgggacccctgacgcgtattctctcggctccagctcagcgacaacagtacacgttcgaccatcgagtggactccgaggcgagaggacgaggctagactattacgtgtacagttaccatacgaagacgagacgtaggtacggccttaatttagtaggttacgttaacggttccggggacgggaaacggtaaacctaacggtaccgtaaccggtaccggtaacggtacgaaccggtacccgaaacggtcccgtcccggtacccccttcgg

SEQ ID NO: 393130 - DNA, 842 bp, Homo sapiens
  misc_feature: GZ8MTXP02FSR8X.51.3.A03.1.454.CMB.2.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacacgcccaccctcggtgtctgtcgtcctcaggacagacggccaggatcacctgctcgtggagatgctattcgaccaaaagcaaatatgtacttacgtcggtaccagacaagaacgccgacggccgacggccccgttgttcgtttaggtttaactttaaagtaaagtacgtttaggacggacggtcccctacggaccgggaccccgtaggacgtacgtattccgttcgtccggtcctaccgacgtcctacgacgacgaccaaacacgttaccgtaacgttacgaacctataccgaagggtacggtaccgtaccgaagggacgaaggggaacgggaacggaacggtcccgttaaggtaaacctttaagtttaaaccgtcggttaaacgtaacggtttaccgaaacttaacccgggaaagtaaacccgaaggtacccgttagggtaccggggtaaccttaaagttttacggttacggtttaaccggggtttaaccggtaccggggggttaaaccccggggaaaaccgggggtaaaaaccccgttaaaacccggttacccggggtaaacccccggttttacccgggttaaaacgggttcccccggtaaaaacccccggggaaccccggtaaaacccgggggtttaccccgtacccccccgggggttcccccccgtttaaaccccggggg

SEQ ID NO: 393131 - DNA, 552 bp, Homo sapiens
  misc_feature: GZ8MTXP02GBARQ.51.3.A03.1.454.CMB.2.raw
  modified_base (440)..(440): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctcgtggagatgcattgaccaaagcaatatgcttactggtaccagcagaacgccgagccacggcccctgtcttggtttaatttataaagtactttgagtacggtccctcgacgggacccctgacgtcgattccgtctcggcctccagtctacgagccgacaacacggtacacgttcgacatcaagtggacgtaccgaggcaggacgacgagctgtaactattatgtacagtanatacgagacagacaggtgactacttatcgtcgtagtcgggacggtaacggaacctaacgtacgaacccgtccgtaagtacgacgacccgtaaggccgtccgccccgttacgg

SEQ ID NO: 393132 - DNA, 635 bp, Homo sapiens
  misc_feature: GZ8MTXP02JQTES.51.3.A03.1.454.CMB.2.raw
  modified_base (213)..(213): a, c, t, g, unknown or other
  modified_base (298)..(298): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctggtgtctgtgtcctcaggacagacgccaggatcacctgctctgganatgcagttgaccaaagcaaagtatgtcttactggtaccagcagaaacgccgaggccaggcccctgtctttggttattataaagtnttgagacgcctcgacggaccctgacgcgtattctcgtcggtctcagctcgagcgacaaacgacgtcctacgttgaacctagtcgagtggtaacggtcgaaggcaaaggggacggacggtaggtacgtggtaaccttaagttacgtgttaccgagttccgtaatacgaacgaaccgagtaccgtaggttcgacttacgtttacgtcggttaccggttacggttaccgggaacgggtaaccggggtaaaccctaaaaccggttccggaaacccgtttacgtaaccggtccgtaccggacccccggtaaggtccccgttcccggtcccccggtttaacgg

SEQ ID NO: 393133 - DNA, 523 bp, Homo sapiens
  misc_feature: GZ8MTXP02INVDB.51.3.A03.1.454.CMB.2.raw
  modified_base (217)..(217): a, c, t, g, unknown or other
  modified_base (315)..(315): a, c, t, g, unknown or other
  modified_base (337)..(337): a, c, t, g, unknown or other
  modified_base (373)..(373): a, c, t, g, unknown or other
  modified_base (425)..(425): a, c, t, g, unknown or other
  modified_base (430)..(430): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (440)..(440): a, c, t, g, unknown or other
  modified_base (442)..(442): a, c, t, g, unknown or other
tcagcgatcgtatacacgaccggtgctcgatttagagagcgtcacgagggggtgggtccaggaggcagaactctgggtgtctcaccatggcctggatccctctacttctccccctcctcactctctgcacaggctctgaggcctcctatgagctgacacagccaccctggtgtctgtgtcctcagggacaggacggccaggatcacctgctctgganatgactattcgaccaaagcaaatatgcttactggtaccaggcaagaagccaaggccacggcccctgtcctttggttattataagctttgagcggcctnacgggaccctgacgcgtatctntacggctccagctcacgcgactaacagtccacgttnaccatcacgtggaacgtccgaggcagagacgagtcagactagttactgtacngtcananagnagngngngatatagtgtcgtacgtcggacggacggacgtacgtacgtacgtacgtaacgtacgacgaccgacgcgtccgtcccgtccg

SEQ ID NO: 393134 - DNA, 902 bp, Homo sapiens
  misc_feature: GZ8MTXP02GQNEH.51.3.A03.1.454.CMB.2.raw
  modified_base (215)..(215): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctctatgagctgacacagccacctcggtgtctgtcgtcctcaggacagacggccaggatcacctgctcgtgganatgctagttcgacctaaaagcaaatagtcgtacttacgtacggtaaccagcaacggaacgaccgaacggtcccgaacggtcccccgttgttccgtttaggtttaattttaaacgtaaaacgtacgttttaggaacggtacggtaccccgttaccgaaccggggtacccccttagggacggtaccggttaactttccgttcggtcccggtaccttacccgaacggtccttaacgacggaacccgaaccgaaacgaacggttaccgtaaccgggtttacgaaaccctaacgttacccgaaagggttcggggtaaaccggttacccgaacgggggtaacccgtaaaggggtaacgggggtaaaccgggacggggtacccttaagggtaaaacctttaaacgttttaaacggttaccggtttaaaccggtaaggtttaacccgtaatttaaaccccgtaagggtaaaccaacggtaaaccggttaggggttaccgggtaaacccttaacgttttaagggttccggtttaccgggtttaaaacggtttcccggggggaaaccgggggttaaaaccgggaaaccccgttaaaaccggttacccggtaacccggtttacccgaacgggtttaccggaaaccccggttaaccggaacccggtaacccgttcccggtaccccccggtttaacccgg

SEQ ID NO: 393135 - DNA, 670 bp, Homo sapiens
  misc_feature: GZ8MTXP02JJGJW.51.3.A03.1.454.CMB.2.raw
  modified_base (218)..(218): a, c, t, g, unknown or other
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtcgtcctcaggacaggacggccaggatccacctgctctgganatgcattcgaccaaagcaaatatgcttaactggtaccagcagaacgccaggccaggcccctgtctttggttaattaagtaaagtctttagaagacggcccctgaacgggtcccctgagccgtattctctcggcctccgagtctacagaccgacaaacgtacgtcctaacgttacgaacccaattccgaaaggttcggaacgtacccgaagggaccaaaggggaacgggaccggaaggggtacccttaaggtaacctttaacgttactaggttaacctaacggactaactaacggaacgaaaccgaggacccggtaagggtcgaaccttacgttagtaggttacgtacgggttaccgggaacggggtaaacgggaaacctaacgtaccgggtaaccgtacggttaacgaaccgacgtaacccggaagtccccggtcccgtaacccggttcccg

SEQ ID NO: 393136 - DNA, 420 bp, Homo sapiens
  misc_feature: GZ8MTXP01ANBWJ.21.46.E02.1.454.CMB.2.raw
  modified_base (415)..(420): a, c, t, g, unknown or other
tcagtcgtcgctcgcacgaccggtgctcgatttagactcatctacagggaaaggggctggtctgggtctcacggattaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctcgcctggtcaaggctaacttcccgaagcgacgactgagcgggctggcaaggcgcatagnnnnnn

SEQ ID NO: 393137 - DNA, 425 bp, Homo sapiens
  misc_feature: GZ8MTXP01EBPGJ.21.46.E02.1.454.CMB.2.raw
  modified_base (385)..(385): a, c, t, g, unknown or other
  modified_base (418)..(425): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagttggttattattccgtgggggccaggggaaccctggtaaaccgtctcctcagcctcaccaaggcccatcggtctcccctggcgccctgctccaggacgcacctccgagacgcacagccgccctgggctcgcctggtcaaggctaacttcccgngcgacgactgagcgggctggcaaggcgcatagnnnnnnnn

SEQ ID NO: 393138 - DNA, 422 bp, Homo sapiens
  misc_feature: GZ8MTXP01BUME5.21.46.E02.1.454.CMB.2.raw
  modified_base (383)..(383): a, c, t, g, unknown or other
  modified_base (416)..(422): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctggggctcgcctggtcaaggctaacttcccgngcgacgactgagcgggctggcaaggcgcatagnnnnnnn

SEQ ID NO: 393139 - DNA, 426 bp, Homo sapiens
  misc_feature: GZ8MTXP01DGDNX.21.46.E02.1.454.CMB.2.raw
  modified_base (387)..(387): a, c, t, g, unknown or other
  modified_base (420)..(426): a, c, t, g, unknown or other
tcagtcgtcgctcgcacgaccggtgctcgatttagactcatctacagggaaagggctggtctgggtctcacggattaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattccgtgggggccaggggaaccctgggtaaacccgtctcctcagcctccaccaagggcccatcggtcttccccctggcgccctgctccaggacgcacctccgagagcacagcggccctgggctcgcctggtcaaggctaacttcccgngcgacgactgagcgggctggcaaggcgcatagnnnnnnn

SEQ ID NO: 393140 - DNA, 417 bp, Homo sapiens
  misc_feature: GZ8MTXP01EGLPV.21.46.E02.1.454.CMB.2.raw
  modified_base (312)..(312): a, c, t, g, unknown or other
  modified_base (325)..(325): a, c, t, g, unknown or other
  modified_base (380)..(380): a, c, t, g, unknown or other
  modified_base (411)..(417): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatccgtggggccagggaaccctggtaaccgtctcctcagcctccaccaagggcccatcgtcttccccctggcnccctgctccaggngcacctccgagagcacagcgccctgggctcgcctggtcaaggactaacttcccgngcacgactgagcgggctggcaagcgcatagnnnnnnn

SEQ ID NO: 393141 - DNA, 578 bp, Homo sapiens
  misc_feature: GZ8MTXP01DH5LQ.21.46.E02.1.454.CMB.2.raw
  modified_base (262)..(262): a, c, t, g, unknown or other
  modified_base (340)..(340): a, c, t, g, unknown or other
  modified_base (374)..(374): a, c, t, g, unknown or other
tcagtcgtcgctcgcacgaccggtgctcgatttagactcatctacagggaaagggtgtacacctgtggttctcgggctgccctttggttttggagatggttttctcgatgggggctgggaggcttagttcaaccggggggtccctgagactctcttgtgcagcctctcgatttaacttcaatatttactggatgcactgggtccgccaagctccagggagggctggtctgggtctcacggattaaaactgacggactaccanaaactacgcggactcgtgaagggccgttcaccatctccagagacaacgccaagagcacgctctatctgcaaatgaacngtctgagagtcgaggcatggctgtatatactgtncgaggagaaagggctgggagttggttatattcgtgggccagggacctggtaacgtctcctcacgcctccaccgaacgggcccactccggtccttcccccgtggcccgccccgttgcctccgaggacgccacctccgacgacgcacgacgccggccccgttgggcctggccctgggtccaagggttacctaaccgttcccgaacg

SEQ ID NO: 393142 - DNA, 438 bp, Homo sapiens
  misc_feature: GZ8MTXP01B41IO.21.46.E02.1.454.CMB.2.raw
  modified_base (395)..(395): a, c, t, g, unknown or other
  modified_base (431)..(438): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaaccctgggtaaccgtctcctcagcctccaccaagggcccatcggtccttccccctggccgcccctgcctccaggacgccacctccgagagcacagccggccctggggcctcgcctggtcaagggctaaccgttcccgngccgacgactgacggcgggctggcaaggcgcatagnnnnnnnn

SEQ ID NO: 393143 - DNA, 589 bp, Homo sapiens
  misc_feature: GZ8MTXP01DXR7Y.21.46.E02.1.454.CMB.2.raw
  modified_base (381)..(381): a, c, t, g, unknown or other
  modified_base (516)..(516): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggagggctggtctgggtctcacggattaaaactgacggactaccacaaactacgcggactccgtgaaagggccggttcaccatctccagagacaacgccaagagcacgctctatctgcaaatgaacagtctgagagtcgaggacatggctagtatattactgngcagggagaaagggctgggagtgggttattattccgtggggccagggaccctggtaaaccgtcgtcctcacgccctaccaccgaacgggcccacgtcggtccttcccccgtggcccgccctggcctccgacgganccacctcgagacgcttacgacgcggccccgttggggcctgcccgtggtccaagggaccttcgttcccgaacgg

SEQ ID NO: 393144 - DNA, 421 bp, Homo sapiens
  misc_feature: GZ8MTXP01DANCR.21.46.E02.1.454.CMB.2.raw
  modified_base (312)..(312): a, c, t, g, unknown or other
  modified_base (379)..(379): a, c, t, g, unknown or other
  modified_base (414)..(421): a, c, t, g, unknown or other
tcagtcgtcgctcgcacgaccggtgctcgatttagactcatctacagggaaaggggctggtctgggtctcacggattaaactgacgggactaccacaaactacgcggactccgtgaagggccggttcaccatctccagagacaacgccaagagcacgctctatctgcaaaatgaacagtctgagagtcgaggacatggctgtatattactgtgcaggagaaagggctggagtggttatatccgtggggccagggaaccctggtaaccgtctcctcagcctccaccaagggcccatcggtcttccccctggcnccctgctccaggagcactccgagagcacagcggccctgggctcgcctggtcaaggctaacttcccgngcgacgactgagcggggctgggcaaggcgcatagnnnnnnnn

SEQ ID NO: 393145 - DNA, 421 bp, Homo sapiens
  misc_feature: GZ8MTXP01DIQUW.21.46.E02.1.454.CMB.2.raw
  modified_base (309)..(309): a, c, t, g, unknown or other
  modified_base (313)..(313): a, c, t, g, unknown or other
  modified_base (378)..(378): a, c, t, g, unknown or other
  modified_base (413)..(421): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtgggggccaggggaaccctggtaaaccgtctcctcagcctcaccaggcccatcggtctcccccnggcnccctgctccaggacgcacctccgagagcacagcgccctggctgcctggcaaggctaacttcccgngcgacgactgagcgggctgggcaaggcgcagtagnnnnnnnnn

SEQ ID NO: 393146 - DNA, 427 bp, Homo sapiens
  misc_feature: GZ8MTXP01BOJO0.21.46.E02.1.454.CMB.2.raw
  modified_base (387)..(387): a, c, t, g, unknown or other
  modified_base (420)..(427): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaaccctggtaaccgtctcctcagcctccaccaaggcccatcggtcttccccctggccgccctgctccaggacgccacctccgagagcacacgcggcccctgggcctgcctggtcaaggctaaccttcccgngcgacgactgagcgggctggcaaggcgcatagnnnnnnnn

SEQ ID NO: 393147 - DNA, 420 bp, Homo sapiens
  misc_feature: GZ8MTXP01DER9J.21.46.E02.1.454.CMB.2.raw
  modified_base (381)..(381): a, c, t, g, unknown or other
  modified_base (414)..(420): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctggtaaccgtctcctcagcctccaccaaggcccatcggtcttccccctggcgcccctgctccaggcgcacctccgagagcacagcggccctgggctcgcctggtcaaggctaacttcccgngcgacgactgagcgggctggcaaggcgcatagnnnnnnn

SEQ ID NO: 393148 - DNA, 619 bp, Homo sapiens
  misc_feature: GZ8MTXP01CGRED.21.46.E02.1.454.CMB.2.raw
  modified_base (324)..(324): a, c, t, g, unknown or other
  modified_base (533)..(533): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccgagggaagggctggtctgggtctcacggattaaaactgacggactaccacaaactacgcggactccgtagaacgggccggttcaccatctccagagacaacgccaagncacgctctatctgcaaatgaacagtctagagagtcgaggacagtcggctgtatattacgtgtgcgaggaagaaaggggctggagtcgttattagttccgtggggccagggaaccctggtaacccgtctcctcacgcctaccaccgaacgggccccagttccggtcccttcccccgtcggcccgtcccctcgccctccgaacgggcgccncccgtcccgaacggacgcccacgacgcccggcccgttgggccgtaacgcccgtcggtcgaacgggccttaaccgttcccggaacgg

SEQ ID NO: 393149 - DNA, 598 bp, Homo sapiens
  misc_feature: GZ8MTXP01D728T.21.46.E02.1.454.CMB.2.raw
  modified_base (487)..(487): a, c, t, g, unknown or other
  modified_base (545)..(545): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccgagggaagggctggtctgggtctcacggattaaaactgacggactaccacaaactacgcgactccgtgaagggccgttcacatctccagagacaacgccaagagcacgctctatctgacaaatgaacagtctgagagtcgaggacagtcggctgtatattactgtagcgaggaagaaagggactgggtagtgttatatcgtggggaccagggaccctggtaacccgtctcctcacgcctccaacgacgggcccagtccggtccttccccgngccgccctgcctccgacgcgccaccgtcccgagacgccaacgacggccggttccccgnggggccctcggacccgtgggtaaccaacgggaccttaacccgttccccggaag

SEQ ID NO: 393150 - DNA, 441 bp, Homo sapiens
  misc_feature: GZ8MTXP01DM9RS.21.46.E02.1.454.CMB.2.raw
  modified_base (275)..(275): a, c, t, g, unknown or other
  modified_base (310)..(310): a, c, t, g, unknown or other
  modified_base (324)..(324): a, c, t, g, unknown or other
  modified_base (334)..(334): a, c, t, g, unknown or other
  modified_base (421)..(431): a, c, t, g, unknown or other
  modified_base (433)..(441): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatccgtggggccagggaccctggtaaccgtctcctnagcctccacaaggcccatcggtctccccctggccnccctgctccaggcncacctccganagcacagccgcctgggctcgcctggtcaaggcctaaccttcccgaagcgacgactgaggcggggctgggacaaggggcacgagtagnnnnnnnnnnngnnnnnnnnn

SEQ ID NO: 393151 - DNA, 440 bp, Homo sapiens
  misc_feature: GZ8MTXP01APMJR.21.46.E02.1.454.CMB.2.raw
  modified_base (314)..(314): a, c, t, g, unknown or other
  modified_base (328)..(328): a, c, t, g, unknown or other
  modified_base (432)..(440): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatccgtggggccagggaaccctggtaaccgtctcctcagcctccaccaagggcccatcggtcttccccctggccnccctgctccaggancacctccgagagcacagccggccctggggcctcggccctggtcaaggacctaaccgttccccgaagccgacgactggagcggggctgggacaagggcgcatagnnnnnnnnn

SEQ ID NO: 393152 - DNA, 483 bp, Homo sapiens
  misc_feature: GZ8MTXP01C11A8.21.46.E02.1.454.CMB.2.raw
  modified_base (421)..(421): a, c, t, g, unknown or other
  modified_base (444)..(444): a, c, t, g, unknown or other
  modified_base (463)..(473): a, c, t, g, unknown or other
  modified_base (475)..(483): a, c, t, g, unknown or other
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatccgtggggaccagggaaccctgggtaacccgtctccctcacgccctacccgaccgaacgggcccctacgttccggtcccttcccccccgtgggcccgtcccctgcctccgaggacgccacccgtccgagacgcacgaggccgcccgtgggctcgccgtggacaacgtactaaccgtcccgngccgacgactggacggcgggtcncgggacaaggcgacagagnnnnnnnnnnngnnnnnnnnn

SEQ ID NO: 393153 - DNA, 437 bp, Homo sapiens
  misc_feature: GZ8MTXP01AMCMH.21.46.E02.1.454.CMB.2.raw
  modified_base (316)..(316): a, c, t, g, unknown or other
  modified_base (337)..(337): a, c, t, g, unknown or other
  modified_base (396)..(396): a, c, t, g, unknown or other
  modified_base (429)..(437): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaagggactggagtggttattattccgtgggggccaggggaaccctgggtaacccgtctcctcagccctccaccaagggcccatcggtccttcccccnggccgcccctgcctccagganccacctccgagagcacgagccggccctggggctcgccctggtcaaggactacttcccgngcgacgactgagcgggctggcaaggcgcatagnnnnnnnnn

SEQ ID NO: 393154 - DNA, 613 bp, Homo sapiens
  misc_feature: GZ8MTXP01CK364.21.46.E02.1.454.CMB.2.raw
  modified_base (327)..(327): a, c, t, g, unknown or other
  modified_base (425)..(425): a, c, t, g, unknown or other
  modified_base (529)..(529): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcgaaccgggggggtccctgagactctcttgtgcagcctctcgatttaacttcaatatttactggatgcactgggtccgccaagctccgagggaaggggctgggtctgggtctcacggaattaaaactgacggactaccacaaactacgcggactccgtgaagggccggttcaccatctccagagacaacgccaaagngcacgctctatctgcaaatgaacagtctgagagtcgaggacatcggctgtatattactgtgcgaggaagaaagggctgggagtggttattacgttcgngggccagggaaccctggtaaccgtctcctcacgcctaccaccgaacgggccctaacgttccggtaccttcccccgtggcccgcccttggcccttccgagggacnccacccgtccggagacggccacgacgccgggccccgttgggccttcggcctcgggtacgacggaccttaaccgttcccggaacg

SEQ ID NO: 393155 - DNA, 587 bp, Homo sapiens
  misc_feature: GZ8MTXP01AYEMG.21.46.E02.1.454.CMB.2.raw
  modified_base (266)..(266): a, c, t, g, unknown or other
  modified_base (510)..(510): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaagggctggtctgggtctcacggattaaaactgacgggactaccanaaactacgcggactccgtgaagggccggttcaccatctccagagacaacgccaagagcacgctctatctgcaaatgaacagtctgagagtcgaggacatcggctgtatattactgtgcagggaagaaagggctgggagttgttattattcgtgggccgagggaaccctggtaaccgtctcctcagcctccaccaacgggcccagtccggtcctccccgtggccgccctgcctccgaggacgccnccctccgagacgccacgacgccggccccgttgggcctcgcccgtcggtcaacgggttacctaaccgttcccggaacg

SEQ ID NO: 393156 - DNA, 474 bp, Homo sapiens
  misc_feature: GZ8MTXP01AS5F2.21.46.E02.1.454.CMB.2.raw
  modified_base (451)..(451): a, c, t, g, unknown or other
  modified_base (455)..(474): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatccgtggggccagggaccctggtaaccgtctcctcagcctccaccaagggcccatcggtccttccccctggccgcccctgcctcccaggacgcacctccgagacgcacacgccggtcccctggggccttacggcccctgggtaccaaagggaccttaaaccgttccccgggaagccgaacgacgtgacgcggggactgggacaaggccganatgnnnnnnnnnnnnnnnnnnnn

SEQ ID NO: 393157 - DNA, 495 bp, Homo sapiens
  misc_feature: GZ8MTXP01DT41V.21.46.E02.1.454.CMB.2.raw
  modified_base (354)..(354): a, c, t, g, unknown or other
  modified_base (477)..(477): a, c, t, g, unknown or other
  modified_base (479)..(495): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaccctggtaaccgtctcctcagccctccaccgaagggccccagtccggtccttcccccctggccgcccctgcctcccgaggacgccacctccgagcncacgacgccggccccgtgggcctcgcccgtggtacgaaacggtacccttaacccgttccccggaagccgaaccggacgtcgggacgggccgggggcgtcgggacgaagggccgacaagtaggngnnnnnnnnnnnnnnnnn

SEQ ID NO: 393158 - DNA, 540 bp, Homo sapiens
  misc_feature: GZ8MTXP01EMRUL.21.46.E02.1.454.CMB.2.raw
  modified_base (321)..(321): a, c, t, g, unknown or other
  modified_base (476)..(476): a, c, t, g, unknown or other
  modified_base (487)..(487): a, c, t, g, unknown or other
  modified_base (491)..(491): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaagggctggtctgggtctcacggattaaaactgacggactaccacaaactacgcggactccgtgaagggccggttcaccatctccagagacaacgccaagngcacgctctatctgcaaatgaacagtctgagagtcgaggacatggctgtatattactgtgcaggagaaagggctgggagtgttattattcgtgggcagggaaccctggtaaccgtctcctcagcctcacgacggcccatcggtctccccgtgccncctgctccagngccnctcgagcgcacgagtcgccgttggctgctgtcaggctaacgttccgaag

SEQ ID NO: 393159 - DNA, 434 bp, Homo sapiens
  misc_feature: GZ8MTXP01EGV96.21.46.E02.1.454.CMB.2.raw
  modified_base (312)..(312): a, c, t, g, unknown or other
  modified_base (315)..(315): a, c, t, g, unknown or other
  modified_base (323)..(323): a, c, t, g, unknown or other
  modified_base (384)..(384): a, c, t, g, unknown or other
  modified_base (423)..(434): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactgtgcaaggagaaaggggctgggagttggttattatccgtggggccagggaccctggtaaccgtctcctcagcctccaccaggcccatcgtcttcccctgcnccngctccagngcacctccgagagcacgagccggccctgggcctcgcctggcaaggacctaaccttccccgngtccgacgactggagcgggcgtggcaaggcgacagtagnnnnnnnnnnnn

SEQ ID NO: 393160 - DNA, 468 bp, Homo sapiens
  misc_feature: GZ8MTXP01AXT6V.21.46.E02.1.454.CMB.2.raw
  modified_base (322)..(322): a, c, t, g, unknown or other
  modified_base (338)..(338): a, c, t, g, unknown or other
  modified_base (356)..(356): a, c, t, g, unknown or other
  modified_base (445)..(455): a, c, t, g, unknown or other
  modified_base (457)..(468): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattagttccgtggggccaggggaaccctggtaaccgtctcctcacgcctccaccgaagggcccatccggtccttccccctggccnccctgcctccgaggcncaccgtcgagacgcacgngccggccctgggcctcgccgtggtacgaacggtcctaaccgtcccgaagccgacgactggacgcggggctcggacaacggcgctagagnnnnnnnnnnngnnnnnnnnnnnn

SEQ ID NO: 393161 - DNA, 785 bp, Homo sapiens
  misc_feature: GZ8MTXP01B622R.21.46.E02.1.454.CMB.2.raw
  modified_base (312)..(312): a, c, t, g, unknown or other
  modified_base (328)..(328): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccggggggggtccctgagactctcttgtgcagcctctcgattttaacttcaatatttactggatgcactgggtccgccaagctccgagggaaggggctggtctgggtctcgaacggattaaaactgacgggactaccaacaaactacgcggactccggtagaacgggccgtcaccatcncagagacacgccaagngcacgctctatctgacaaatgaacagtctagagagtcgaaggacagtcggctagtatattctagtgcgagggaaggaaaggggtctagggtaggttaggtttaactttacgttccggtacgggggacccgtaacggggtaaccccgttgggttaaaccccgttctacccgtacgaccgtcccctacccgaaccggaaaccggggcccctaacggtttccccgggttcccccttacccccggtcgggtcccccgtaccccgtcggtacccctacccgggaacgggtaccgaccccgtaaccccggtaacccgggaacggttcggaaccccgacccggaaccggggcccccgggttccccgggttcggggggttccccttccggggtaccccggttcggggtaaaccccgaaacccgggggttacccctttaacccccgggttccccggggaaaccggg

SEQ ID NO: 393162 - DNA, 518 bp, Homo sapiens
  misc_feature: GZ8MTXP01AUP2W.21.46.E02.1.454.CMB.2.raw
  modified_base (346)..(346): a, c, t, g, unknown or other
  modified_base (494)..(518): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccgttcaccatctccagagacaacgccaagagcacgctctatctgcaaatgaacagtctgagagtcgaggacatggctgtatattactgtgcaggagaaagggctggagttggtttattagttccgtgggggccacgggaacccttgggtaacccgtctcctcacgccctccaccgaggcccagtccgtccttcccccctggcccgccctgcctaccgaggacnccacccgtccggagacgcacgacggcccggcccgtggggcctcggcccgtagggttacgaaccggtacctaacccgttcccggaagcccggaacccgtacgtcgggacgggcccggggacgtacgggccgaaagggccgacagtaggnnnnnnnnnnnnnnnnnnnnnnnnn

SEQ ID NO: 393163 - DNA, 838 bp, Homo sapiens
  misc_feature: GZ8MTXP01BO67E.21.46.E02.1.454.CMB.2.raw
  modified_base (191)..(191): a, c, t, g, unknown or other
  modified_base (251)..(251): a, c, t, g, unknown or other
  modified_base (264)..(264): a, c, t, g, unknown or other
  modified_base (281)..(281): a, c, t, g, unknown or other
  modified_base (300)..(300): a, c, t, g, unknown or other
tcagtcgtcgctcgcacgaccggtgctcgatttagactcatctacagggaaagggtgtacacctgtggttctcggggctgccctttggttttggagatggttttctcgatggggggctgggaggcttagttcaaccggggggtccctgagactctcttgtgcagcctctcgatttaacttcaatatttacnggatgcactgggtccgccaagctccagggaagggctggtctgggtctcacggattaaacngacggactaccanaaactacgcgactccgngaacgggccgtcaccatcnccagagacaacgcaagagcacgctctatctagacaaatcgaactaggtctagaggagtacggaacggacagtcggcttagtatattacgtggtcgcgaaggggaaaggtaaaggggtactagggggtaaggtttaggggttttaaacgtttacgtttcccgggtaggggggtacccggtaaccgggggttaaacccccgttacgggggtttaaaccccgttcccgttaccccgttccggaaccggttccccctaacccgtaacccgggtaaaccggggtacccccttacggttccccggggtttaccccctttccccccgggtccggggtcccccgtcccccggttcggtaccccgtccccggaagggtaccgccccggtaaaccccgttcccgggaaacggttaccggaccccgaaaccgggtccgggcccccggggttcccgggttccgggggttcccttaaccgggggtcccctttccgggggtaaccaacccgggggttacccccttttaacccgggttccccgggaaccgggg

SEQ ID NO: 393164 - DNA, 417 bp, Homo sapiens
  misc_feature: GZ8MTXP02I9UOE.21.46.E02.1.454.CMB.2.raw
  modified_base (409)..(417): a, c, t, g, unknown or other
tcagtcgtcgctcgcacgaccggtgctcgatttagactcatctacagggaaagggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctggtaaccgtctcctcagcctccaccaagggcccatcggtcttccccctggcgccctgctccaggagcacctccgagagcacagcgccctgggctgcctggtcaaggctacttcccgagcacgactgagcgggctggcaaggcgcatagnnnnnnnnn

SEQ ID NO: 393165 - DNA, 419 bp, Homo sapiens
  misc_feature: GZ8MTXP02HSJII.21.46.E02.1.454.CMB.2.raw
  modified_base (377)..(377): a, c, t, g, unknown or other
  modified_base (409)..(419): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttatattcctggggccagggaaccctggtaaccgtctcctcagcctccaccaagggcccatcggtcttccccctggccgccctgctccaggagcacctccgagagcacagcgccctggctgcctggtcaaggctacttcccgngcgacgactgagcggctggcaaggcgcatagnnnnnnnnnnn

SEQ ID NO: 393166 - DNA, 416 bp, Homo sapiens
  misc_feature: GZ8MTXP02GCXVI.21.46.E02.1.454.CMB.2.raw
  modified_base (378)..(378): a, c, t, g, unknown or other
  modified_base (411)..(416): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctgggccagggaccctggtaaccgtctctcagcctccaccaagggcccatcggtcttccccctggcgcccctgctccaggagcacctccgagagcacagcggccctgggctgcctggtcaaggctacttcccgngcgacgactgagcgggctggcaaggcgcatagnnnnnn

SEQ ID NO: 393167 - DNA, 508 bp, Homo sapiens
  misc_feature: GZ8MTXP02I55TH.21.46.E02.1.454.CMB.2.raw
  modified_base (486)..(486): a, c, t, g, unknown or other
  modified_base (488)..(508): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctgggagttggttattattccgtggggccagggaacccctgggtaacccgtctcctcagcctccaccaagggccccatccggtccttccccctggccgcccctgcctccgaggacgccaccctccggagacgccacacggccggcccctggggcctcggccccgtgggtaccaaacgggtaccttacccgttccccggaggccgaaccggaccgtggacgggccggggactcggggaccgaaacgggccgacgaagtaggngnnnnnnnnnnnnnnnnnnnnn

SEQ ID NO: 393168 - DNA, 597 bp, Homo sapiens
  misc_feature: GZ8MTXP02HNF72.21.46.E02.1.454.CMB.2.raw
  modified_base (347)..(347): a, c, t, g, unknown or other
  modified_base (418)..(418): a, c, t, g, unknown or other
  modified_base (540)..(540): a, c, t, g, unknown or other
tcagtcgtcgctcgcacgaccggtgctcgatttagactcatctacagggaaagggtgtacacctgtggttctcggggctgccctttggttttggagatggttttctcgatggggctgggaggcttagttcaaccggggggtccctgagactctcttgtgcagcctctcgatttaacttcaatatttactggatgcactgggtccgccaagctccagggaagggctggtctgggtctcacggattaaaactgacgggactaccacaaactacgcggactccgtgaaggccggttcaccatctccagagacaacgccaaagagcaacgctctatctgcaaaatgaaacngtctgagagtcgaggacatggctgtatattactgtgcaaggagaaagggactgggagtggttatattccgngggggaccagggaaccctggtaaacccgtctcctcacgccctacaccgaaacgggccccagttccgggttcccttcccccgtggcccgtcccctgcctccgaggacgcacccgtccgagacnccacgacgccggccctggggcctggccctggtcaaacggtacctaccttacccggag

SEQ ID NO: 393169 - DNA, 425 bp, Homo sapiens
  misc_feature: GZ8MTXP02G65PQ.21.46.E02.1.454.CMB.2.raw
  modified_base (417)..(425): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatcctggggccagggaaccctggtaaccgtctcctcagcctccaccaagggcccatcggtctcccctgcgccctgctccaggacgcacctccgagagcacagccggcccctggggcctcgcctggtcaagggctacttccccgagcgacgactgagcggggctggcaaggcgcatagnnnnnnnnn

SEQ ID NO: 393170 - DNA, 413 bp, Homo sapiens
  misc_feature: GZ8MTXP02GAP11.21.46.E02.1.454.CMB.2.raw
  modified_base (338)..(338): a, c, t, g, unknown or other
  modified_base (374)..(374): a, c, t, g, unknown or other
  modified_base (407)..(413): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccacaagggcccatcgtctcccctgcgcctgctccaggagcacctccgagagcacngcggccctgggctcgcctggcaaggctacttcccgngcgacgactgagcgggctggcaaggcgcatagnnnnnnn

SEQ ID NO: 393171 - DNA, 444 bp, Homo sapiens
  misc_feature: GZ8MTXP02JKF61.21.46.E02.1.454.CMB.2.raw
  modified_base (398)..(398): a, c, t, g, unknown or other
  modified_base (431)..(444): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagttggttattattccgtggggccaggggaaccctgggtaacccgtctcctcagcctccaccaagggccccatccggtccttcccccgtggcccgcccctgcctccgaggacgccacctccgagacgcacagccggccctgggctcgcctggtcaaggctacttcccgngcgacgactgagcgggctggcaaggcgcatagnnnnnnnnnnnnnn

SEQ ID NO: 393172 - DNA, 573 bp, Homo sapiens
  misc_feature: GZ8MTXP02F30CV.21.46.E02.1.454.CMB.2.raw
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaagggctggtctgggtctcacggattaaaactgacgggactaccacaaactacgcggactccgtgaagggccggttcaccatctccagagacaacgccaaagagcacgctcatctgcaaaatgaaacagtctgagagtcgaggacatggctgtatattactgtgcaggagaaaaggggctgggaagtgggttaattaattccgtggggtccagggaaccctggtaaccgtctacctcagcctccaccaacgggcccactcggtccttccccctggccgccctgcctccaggacgcacctccgagacgcacacgccgccctgggcctgcctcggcaacggactacttcccgacg

SEQ ID NO: 393173 - DNA, 583 bp, Homo sapiens
  misc_feature: GZ8MTXP02FZQKO.21.46.E02.1.454.CMB.2.raw
  modified_base (383)..(383): a, c, t, g, unknown or other
  modified_base (439)..(439): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccgagggaagggctggtctgggtctcacggattaaaactgacgggactaccaacaaactacgcggactccgtgaagggccggttcaccatctccagagacaacgccaagagcacgctctatctgacaaaatgaacagtctgagagtcgaggacatggctgtatattacngtgcaggagaaagggctggagtggttatatcgtgggcaggacctgtaaccgtctcncacgcctccaccaacggccacgtccgtcccttcccccgtggcccgtccctcgcctccgacggacgccacccgtccgacgacgccacgacggccggcccgtcgggctcgccgtcggtaccgaacggacctaccgttcccggaacg

SEQ ID NO: 393174 - DNA, 609 bp, Homo sapiens
  misc_feature: GZ8MTXP02JWB7R.21.46.E02.1.454.CMB.2.raw
  modified_base (252)..(252): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaagggctggtctgggtctcacggattaaaacngacgggactaccacaaactacgcggactccgtgaagggccggttcaccatctccagagacaacgccaaagagcacgctctatctgcaaaatgaacagtctgagagtcgaggacatggctgtatattactgtgcaggagaaagggctgggagttggttattagttccgtgggggccaaggggaccctggtaaccgtctcctcacgcctccaaccgaacgggccccagtccggtccttcccccgtggcccgcccctggcctccgacggacgccaacccgtccggacgacggccacgacggcccggccccgtggggcctcgccctggggtaccaaacgggtcctaaccgttccccgaagg

SEQ ID NO: 393175 - DNA, 424 bp, Homo sapiens
  misc_feature: GZ8MTXP02IG6YF.21.46.E02.1.454.CMB.2.raw
  modified_base (384)..(384): a, c, t, g, unknown or other
  modified_base (416)..(424): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctgggtaaccgtctcctcagcctccaccaagggcccatcggtcttccccctggcgccctgcctccaggacgcacctccgagacgcacagccggccctgggctcgcctggtcaaggctacttccgngcgacgatgagcgggctggcaaggcgcatagnnnnnnnnn

SEQ ID NO: 393176 - DNA, 632 bp, Homo sapiens
  misc_feature: GZ8MTXP02IHJZX.21.46.E02.1.454.CMB.2.raw
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggctcacggattaaaactgacgggactaccacaaactacgcgactccgtgaagggccggttcaccatctccagagacaacgccaagagcacgctctatctgcaaaatgaacagtctgagagtcgaggacatcggctagtatattactgtgcagggagaaaggggactagggagtaggtttattatttccgagggggaccaggggaaccctggtaaacccgtctcctcagccctccaaccgaacgggcccaagttccggtacccttcccccgtggcccgtcccctgcctcccgaaggacgccgaccctccggagacgaccaacgacggccgggccccgttggggcctcggtccccgtagggttaccgaaaacgggtccttaaaccgttccccggaacgg

SEQ ID NO: 393177 - DNA, 490 bp, Homo sapiens
  misc_feature: GZ8MTXP02HLXMU.21.46.E02.1.454.CMB.2.raw
  modified_base (474)..(490): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtgttattatccgtgggcagggaccctggtaaccgtctcctcacgccctccgaccgaacgggccccagtccggtcccttcccccctggcccgcccctgcctcccgaggacgccaccctccgagacgccacgacgccggcccctggggcctccgcccgttcgggtacaaacgggtaccttacccgttccccgagccgaaacgacgtcggaacggccggggacttgggacaacggcgacgataggnnnnnnnnnnnnnnnnn

SEQ ID NO: 393178 - DNA, 620 bp, Homo sapiens
  misc_feature: GZ8MTXP02GG7JK.21.46.E02.1.454.CMB.2.raw
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccgagggaaggggctggtctgggtctcacggattaaaactgacgggactaccacaaactacgcggactccgtagaagggccgttcaccatctccagagacaacgccaagagcacgctctatctgacaaatgaacagtctgagagtcgaggacagtggctgtatattactgtgcgaaggaagaaaggggactgggagtggtttaattagttccgtggggccacgggaaccctgggttaaacccgtctcctacacgaccctaccgaccgaacggccccacgttccgtcccttacccccgtggccccgcccgtcgcctaccgaggacgccacccgtccgacgacgccacgacggccggacccgtgggcctcggcccgtacggtacgaacggtacctaccgtcccgacgg

SEQ ID NO: 393179 - DNA, 446 bp, Homo sapiens
  misc_feature: GZ8MTXP02HNA8B.21.46.E02.1.454.CMB.2.raw
  modified_base (333)..(333): a, c, t, g, unknown or other
  modified_base (345)..(345): a, c, t, g, unknown or other
  modified_base (432)..(446): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattatcctggggccagggaaccctggtaaccgtctcctcagccctccaccaacgggcccatccggtccttccccctggccgccctgcctccgaggngccacctcgagngcacgagcgcccgtggctcgacctgtcaacggtactaccgttccgcgtccgacgacgtgacgcgggcgtggacgaggccgcagtagnnnnnnnnnnnnnnn

SEQ ID NO: 393180 - DNA, 447 bp, Homo sapiens
  misc_feature: GZ8MTXP02JJE0M.21.46.E02.1.454.CMB.2.raw
  modified_base (432)..(432): a, c, t, g, unknown or other
  modified_base (437)..(447): a, c, t, g, unknown or other
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggtattattccgtggggccagggaaccctggtaaccgtctcctcacgcctccaccgaagggcccagtcggtccttcccccgtggccgccctgctccgaggcgccacctccgagacgccacacggccggccctggggcctcggcctggtcaaggccttaccgttcccgagcccgacgacgtgagcgggctgggccaaggccnagagnnnnnnnnnnn

SEQ ID NO: 393181 - DNA, 606 bp, Homo sapiens
  misc_feature: GZ8MTXP02F73ZA.21.46.E02.1.454.CMB.2.raw
  modified_base (256)..(256): a, c, t, g, unknown or other
  modified_base (524)..(524): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcgaaccgggggggtccctgagactctcttgtgcagcctctcgatttaacttcaatatttactggatgcactgggtccgccaagctccgagggaaggggctggtctgggtctcacggaattaaaacnggaacgggactaccacaaactacgcggactccgtggaagggcccggttcaccatctccagagacaacgccaaagagcacgctctatctgcaaaatgaacagtctggagagtcgaggacatcggctgtatattactgtgcagggagaaagggctgggattggttattagtcgtggggcccagggaccctggtaaccgtcttcctcacgccctccgaccgacgggcccacgtccgtccttcccccgtgcccgccctgcctccgacggacnccgaccctacggacgacgccacgacgcccggcccgtcgggcctcggccgtcggtccgaacggtacctaccgtacccggacgg

SEQ ID NO: 393182 - DNA, 575 bp, Homo sapiens
  misc_feature: GZ8MTXP02G1456.21.46.E02.1.454.CMB.2.raw
tcagtcgtcgctcgcacgaccggtgctcgatttagactcatctacagggaaagggtgtacacctgtggttctcggggctgccctttggttttggagatggttttctcgatgggggctgggaggcttagttcaaccggggggtccctgagactctcttgtgcagcctctcgatttaacttcaatatttactggatgcactgggtccgccaagctccgagggaaggggctggtctgggtctcacggattaaaactgacggactaccacaaactacgcggactccgtgaaggccggttcaccatctccagagacaacgccaagagcacgctctatctgcaaaatgaacagtctgagagtcgaggacatcggctgtatattactgtgcaggagaaaggggactgggagtggttattagttccgtggggccaggggaaccctgggtaacctcgtcctcacgcctccaccaacgggcccatccggtccttcccccgtggccgccctgcctcccaggacgccaccgtccgagacgcacgacgccggccctgggctcgcctggtcaaggactaccgtccgacg

SEQ ID NO: 393183 - DNA, 433 bp, Homo sapiens
  misc_feature: GZ8MTXP02HGUH0.21.46.E02.1.454.CMB.2.raw
  modified_base (388)..(388): a, c, t, g, unknown or other
  modified_base (425)..(433): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagttggttattattccgtggggccagggaaccctggtaacccgtctcctcagcctccaccaagggcccatcggtctccccctggccgccctgcctccaggacgccacctcgagagcacacgcggccctgggctcgcctggtcaaggactaccttcccgngccgacgactgagccgggctgggcaaggcgcagtagnnnnnnnnn

SEQ ID NO: 393184 - DNA, 462 bp, Homo sapiens
  misc_feature: GZ8MTXP02IH6GL.21.46.E02.1.454.CMB.2.raw
  modified_base (342)..(342): a, c, t, g, unknown or other
  modified_base (428)..(428): a, c, t, g, unknown or other
  modified_base (446)..(462): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaaatgaacagtctgagagtcgaggacatggctgtatattactgtgcaggagaaagggctggagtggttattattccgtggggccagggaaccctggtaacccgtctcctcagccctccaaccgaagggcccagtccggtccttcccccgtggcccgcccctgcctccaggacnccacctccgagacgccacgacggccgcccctggggcctcgccgtggtcaacggactaccgttcccgagccgacgactgacgcgggntcgggcaaggcgcatagnnnnnnnnnnnnnnnnn

SEQ ID NO: 393185 - DNA, 464 bp, Homo sapiens
  misc_feature: GZ8MTXP02JOEY1.21.46.E02.1.454.CMB.2.raw
  modified_base (398)..(398): a, c, t, g, unknown or other
  modified_base (421)..(421): a, c, t, g, unknown or other
  modified_base (441)..(441): a, c, t, g, unknown or other
  modified_base (448)..(464): a, c, t, g, unknown or other
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagttggttattattccgtggggccagggtaaccctggtaacccgtctcctcagcctccaccaagggcccatcggtcctccccctgccgccctgctccaggacgccacctccgagacgccacaggccggtccctgggctcgcccgtggtcaagggactaccgttccccgnggccgacgactggagccgggggntcgggacgaaagggtccganacgtagnnnnnnnnnnnnnnnnn

SEQ ID NO: 393186 - DNA, 506 bp, Homo sapiens
  misc_feature: GZ8MTXP02IV3T9.21.46.E02.1.454.CMB.2.raw
  modified_base (486)..(506): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaaatgaacagtctgagagtcgaggacatggctgtatattactgtgcaggagaaagggctggagttggttattatccgtgggccagggaaccctggtaacccgtctcctcacgccctcccgaaccgaaacgggcccctaacgtccggtcccttccccccgtggccccgcccttcgccgttacccgaggacgcccacccgtcggaagacggcacgacggtccggcccgtggggtcctcggcccgtaggaccaaaacggtcctaccgttcccgaggccgaacgaccgtaggaggtcgggctgggacaaggccacgagannnnnnnnnnnnnnnnnnnnn

SEQ ID NO: 393187 - DNA, 573 bp, Homo sapiens
  misc_feature: GZ8MTXP02H6P7D.21.46.E02.1.454.CMB.2.raw
  modified_base (252)..(252): a, c, t, g, unknown or other
  modified_base (315)..(315): a, c, t, g, unknown or other
  modified_base (342)..(342): a, c, t, g, unknown or other
  modified_base (360)..(360): a, c, t, g, unknown or other
  modified_base (375)..(375): a, c, t, g, unknown or other
  modified_base (486)..(486): a, c, t, g, unknown or other
  modified_base (513)..(513): a, c, t, g, unknown or other
tcagtcgtcgctcgcacgaccggtgctcgatttagactcatctacagggaaagggtgtacacctgtggttctcggggcttgccctttggttttggagatggttttctcgatgggggctgggaggcttagttcaaccggggggtccctgagactctcttgtgcagcctctcgatttaacttcaatatttactggatgcactgggtccgccaagctccgaggggagggctggtctgggtctcacggattaaacngacggactaccacaaactcgcgactcgtgaaggccgttcatcatctcagagacaacgccaagngcacgctctatctagacaaatgaaacngtctgagagtcgaggacntggctagtatattcngtgcaggacgaaagtctggagtgttaattgtccgtggggccaagggaccctggtaacctctctcgacgcctacaccgaacgggcccctagtcccgggtcccttacccccgnggccgtccctggccctccgaggtaccnccaccgtcgagacgcacgcggtcccgccgtggctcgtacgtcgtacgacgtactacgtcg

SEQ ID NO: 393188 - DNA, 733 bp, Homo sapiens
  misc_feature: GZ8MTXP02FT88L.21.46.E02.1.454.CMB.2.raw
  modified_base (299)..(299): a, c, t, g, unknown or other
  modified_base (304)..(304): a, c, t, g, unknown or other
  modified_base (314)..(314): a, c, t, g, unknown or other
  modified_base (379)..(379): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcgaaccgggggggtccctgagactctcttgtgcagcctctcgatttaacttcaatatttactggatgcactgggtccgccaagctccgagggaagggctggtctgggtctcgacggattaaaactgacggactaccacaaactcgcggactcgtgaggccgtcacatcncaganacacgcaagncacgctctatctagacaaaagtgaacagtcagagagtcgaggacagtcggcttgtaatattacgnggttgcgaagggaaagggaaagggactagggtaaggttagggtttaactttaacgttccggtacgggggaccctaacggggaacccgttagggtaaccccgtccttccgtaccgacgtccccctaccgaaacccggtaaacggggccccctaaggtccccggggtttacccctttccccccgggtcggggtacccccgtccccgttacgtcccgtaccggacggaccgtaccctacccggtaccgaacggtaccgaaccgacggacccggtcccggtcccggtccgggttccgtaaccgggtacccggttacgggtaaaccgtaaaccggttacccgttacccgtacccggacg

SEQ ID NO: 393189 - DNA, 785 bp, Homo sapiens
  misc_feature: GZ8MTXP02HCUO3.21.46.E02.1.454.CMB.2.raw
  modified_base (257)..(257): a, c, t, g, unknown or other
  modified_base (310)..(310): a, c, t, g, unknown or other
  modified_base (330)..(330): a, c, t, g, unknown or other
  modified_base (356)..(356): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcgaaccgggggggtccctgagactctcttgtgcagcctctcgatttaacttcaatatttactggatgcacgtgggtccgccaagctccgagggaagggctggtctgggtctcgacggattaaaacgngacgggactaccacaaactacgcggactccgtgaacgggcccggttcacatcnccagacgacaacgccaaagngcacgctctatctgacaaatgaaacngtctgagagtcgaggacatggctgtatattactgtgcgagggaagaaaggggtactggggtaagttgggtttaatttacgttccgttagggggaccctaacgggggtaaaccccttggggtaaacccgttcctacccgttaccgaaccgtaccccgtacccgaaaccggaaaccggggtccccctaacgttcccggggttaccccctttccccccggtacggggccccgtcccccgttcggtccccgttaccccggaaacgggtccgtaccccgaacccccggttacccggaaacgggtaccggaccccgtaaaacccggaccgggtccccggggacccccggttgggggaccccttcgggtccccgttacgggggttaccccaaaacgggggtacccctttaaccccgggtttacccccggaacgggg

SEQ ID NO: 393190 - DNA, 500 bp, Homo sapiens
  misc_feature: GZ8MTXP02JZ5N3.21.46.E02.1.454.CMB.2.raw
  modified_base (486)..(500): a, c, t, g, unknown or other
tcagtcgtcgctcgcacgaccggtgctcgatttagactcatctacagggaaaggggctggtctgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactgtgcaggagaagggcttgagtgttattatccgtgggccagggaccctggtaaccgtctcctcacgccctccaccgaacgggcccagtccggtccttcccccgtggcccgcccctgcctccgaggacgcccaccgtccgagacgcaccgacggcccggcccgtcggggctccggcccgtgggtaccgaaacggtacccttacccgttccccgggagcccggaaccgtacgtcggacggggcggggtccgtagggaccgaacgggcgacgacgtagnnnnnnnnnnnnnnn

SEQ ID NO: 393191 - DNA, 718 bp, Homo sapiens
  misc_feature: GZ8MTXP02HFY2N.21.46.E02.1.454.CMB.2.raw
  modified_base (300)..(300): a, c, t, g, unknown or other
  modified_base (336)..(336): a, c, t, g, unknown or other
tcagtcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaattatttactggatgcacgtgggtccgccaagcctccgaaggggaaggggctggtcgtgggtctcgaacggtaattaaaacgtggaacggactaaccaacaaactacgcggactcggngaacgggccgtcaccatctcagacgacaacgcaagncacgctctatctagacaaaatcgaacagtctaggagtaggtacggaaggacagtcggacttagtaattacttagtgtaggcgaagggaaacggaaaggggtacgtaggggtaggtttaggtttaacgtttacgttccgggtacgggggaccgtaaccgggggtaaacccgttcggggttaaacccgtcccgtcccgttacgaccgtcccctacccggaacccggaacggccccgtacgttcccgttccccttcccccgtcggcccgtcccgtcgtccgtaccggacgtaccgtccacccgtacgacgacgacccgacgtacggcccgtaccgtcggggactccggccgtacgtaccgaacggtacctaccggtacccgacgg

SEQ ID NO: 393192 - DNA, 481 bp, Homo sapiens
  misc_feature: GZ8MTXP02FSQMF.21.46.E02.1.454.CMB.2.raw
  modified_base (325)..(325): a, c, t, g, unknown or other
  modified_base (330)..(330): a, c, t, g, unknown or other
  modified_base (415)..(415): a, c, t, g, unknown or other
  modified_base (448)..(448): a, c, t, g, unknown or other
  modified_base (452)..(481): a, c, t, g, unknown or other
tcagtcgtcgctcgcacgaccggtgctcgatttagactcatctacagggaaaggggctggtttgggtctcacggattaaaaactgacgggactaccacaaactacgcggactccgtgaagggccggttcaccatctccagagacaacgccaagagcacgctctatctgcaaatgaacagtctgagagtcgaggacatggctgtatattactggtcgacaggagaaagggcttggagttgttaattattcccgtggggccagggtaaccctggtaaccgtctacctcacgcctaccaaccgaggccccagtccggtccttaccccnggccnccctgccacgagacgcacctcgagcacacgacggccgccgtggactcgccccgtgggtacaaaggtcctaccgtcccgagcgacncgtgacgcggggatcggaacaacggcgactagngacnnnnnnnnnnnnnnnnnnnnnnnnnnnnnn

SEQ ID NO: 393193 - DNA, 632 bp, Homo sapiens
  misc_feature: GZ8MTXP01BMYKK.41.65.F10.1.454.CMB.2.raw
  modified_base (197)..(197): a, c, t, g, unknown or other
  modified_base (271)..(271): a, c, t, g, unknown or other
  modified_base (280)..(280): a, c, t, g, unknown or other
  modified_base (326)..(326): a, c, t, g, unknown or other
  modified_base (357)..(357): a, c, t, g, unknown or other
  modified_base (374)..(374): a, c, t, g, unknown or other
  modified_base (597)..(597): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttaccagctaacttgcctggtaccacagaacctgggcaggcnccaggctcnatctatgaacactccaccgaggccacgtggtacctccccaacccgnggttcaggtggcgaggtcggggtccccgganagtacgtcactctaccncatcgagccggcctgctagtctaggtaggttatttgacttagttttattaccgttgtaccgagtactaagttaattaacgttaaccggtcggttacccttccgttaccgttaacggtttcccgggggacgggggtaaccgtaaggggtcggtaagtacgttaaccgaaacggtaacgtggttcggacgttcgtaccgtaaccttagttccgttcgtctttccnccttttacccgtccccgttacctgttcccgttaag

SEQ ID NO: 393194 - DNA, 673 bp, Homo sapiens
  misc_feature: GZ8MTXP01AK5EC.41.65.F10.1.454.CMB.2.raw
  modified_base (197)..(197): a, c, t, g, unknown or other
  modified_base (271)..(271): a, c, t, g, unknown or other
  modified_base (280)..(280): a, c, t, g, unknown or other
  modified_base (291)..(291): a, c, t, g, unknown or other
tcagtctatactatcacgaccggtgctcgatttagctacgctctaagggggaggaactgctcagttaggacccagacggaaccatggaagtcccagcgcagcttctcttcctcctgctactctggctcccagataccactggagaaatagtgatgacgcagtctccagccaccctgtctgtgtctccgaggggaaancgcccaccctctcctgcagggccagtcagagtcgtaccagctaacttgcctggaccacagaacctgggcaggcnccagctctnatctatgaacntcccgacgacgggccacgtcggtacctccccaccgtaggttccgaggtcggactagggtcggggtaccccggacaggtcgttccactcctacccgaacatccgacgggccgcctggcctagtcgtaggtaggttattttcggacttagtttactacgtgtaccagtactaagttaactaacgttaaccggtcggtcccttacgttaccggttaaccggtttccggggggacgggggtaaccgtaaaggggttcggaagtaacgttaaccgaaacgggtaacgttcgggttacgggtccttcgggaccctaaaccgttcgttccgttacggtttcccttctaacccggtttccccttacccccggttctaacgttccgttaag

SEQ ID NO: 393195 - DNA, 647 bp, Homo sapiens
  misc_feature: GZ8MTXP01E1OO3.41.65.F10.1.454.CMB.2.raw
  modified_base (196)..(196): a, c, t, g, unknown or other
  modified_base (305)..(305): a, c, t, g, unknown or other
  modified_base (456)..(456): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaancgccaccctctcctgcagggccagtcagagtgtagcagcaacttgcctcgtaaccagcaagaaatcgtggccaggcctccccgaggcctccctctagttcctagtggtnacactccccgacgacgggtcccacgttcgggtactccccgagccgtaaggtttccaggtcggactagggtcggggtctaggggaaacaggtcgttccaacttctaccaccctatcacgtacaggtccctaggctagttctaaggaagtttnttttcgactttagttacttaacgtgtactaaggtctagtaacgttaagtccgtaacgtcgggtccccctcggttaacccgggacgtaacgggtcccaaggtaacccgttaagggaaagttaacgtaaaacccgggtaattgggttcggcttaacgctaaaccctcggttagcgtttaaccttaaccgtccg

SEQ ID NO: 393196 - DNA, 529 bp, Homo sapiens
  misc_feature: GZ8MTXP02IW2LO.41.65.F10.1.454.CMB.2.raw
  modified_base (278)..(278): a, c, t, g, unknown or other
  modified_base (289)..(289): a, c, t, g, unknown or other
  modified_base (343)..(343): a, c, t, g, unknown or other
  modified_base (360)..(360): a, c, t, g, unknown or other
  modified_base (377)..(377): a, c, t, g, unknown or other
  modified_base (382)..(382): a, c, t, g, unknown or other
  modified_base (486)..(486): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgtaccagcaacttgcctggtaccacagaacctgggcaggctccagctctnatctatgaacntccacaggccactggtactcccaccctggttcagtggcaggtcgggccccgganagagttcactctcaccntcgagccgctgcagtcngagtntttgctagtttattactgtctagcagttaataataactcggtcctctacgtacgtttcggggacgggggacctaagggtggagtagtacgaaaacgtacgtggngcgtgacacctactctagtccttcactcctcccgctactctag

SEQ ID NO: 393197 - DNA, 594 bp, Homo sapiens
  misc_feature: GZ8MTXP02HFUBR.41.65.F10.1.454.CMB.2.raw
  modified_base (196)..(196): a, c, t, g, unknown or other
  modified_base (293)..(293): a, c, t, g, unknown or other
  modified_base (324)..(324): a, c, t, g, unknown or other
  modified_base (349)..(349): a, c, t, g, unknown or other
  modified_base (361)..(361): a, c, t, g, unknown or other
  modified_base (366)..(366): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggaccacagaacctgggcaggctcccaggctcctcatctatggaacntccaccgaggcccagtggtactccccacccnggttcagtgcaggtgggccccgganagagttcactcncaccntcagcgcctgcagtctgaggtatttgctagtttattactgtcagctagttataattaacgtcggtaccttcgtactacgtttccgggggaccgggggtacctaaggggttcggaagtacgtaacgaaaacggtaacgttgggtacgggtcctaggacccaaccgtacgttcccttaggttccctttacgtaacttcccgtttacccccgtaccttaacgttccgtacg

SEQ ID NO: 393198 - DNA, 533 bp, Homo sapiens
  misc_feature: GZ8MTXP02FK0B1.41.65.F10.1.454.CMB.2.raw
  modified_base (197)..(197): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttaccagcaacttagcctggtaccacagaaacctgggcaggctccaggctcctcatctatggaacatccaccaggccactggtactccccacccaggttcagtggcaggtgggtcccggacagagttcactctcaccatcagccgcctggcagtctgaggtatttgctagtttatactgtcagtcaagttataaataactggacctctcgtacgtttcggggcgggggtaccgaagggtggagagtacgaaaacgtaactggtggctggacaccgtatctcgtcttcattcctaccgctatctag

SEQ ID NO: 393199 - DNA, 602 bp, Homo sapiens
  misc_feature: GZ8MTXP02IRPJ0.41.65.F10.1.454.CMB.2.raw
  modified_base (196)..(196): a, c, t, g, unknown or other
  modified_base (369)..(369): a, c, t, g, unknown or other
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctagcagggccagtcagagtgtagcagctaacttgcctcgtacagcagaatcgtggccaggctccacggctcctcatctagtggtcgcactccaccgagggcccacgtgggtaccttaccgcgaccgtagggttcaggtcggacgtaggtcggggtcggtangggacgtcgacgttctactcctacaccactcacgcctacgcctagtctagtacgtagtttaagtactttagttacgttacgtttagttacttagtcaagcttaagttaattaacgttacgtacgtccggtcccgttacccgttaccgtacggaacggaaccgtacgtacgtacggcgtaaacgttaaaaccgtacgtcggtcgtcgtacgtaccgactactacgtcgttctac

SEQ ID NO: 393200 - DNA, 601 bp, Homo sapiens
  misc_feature: GZ8MTXP01CRL7U.15.57.F02.1.454.CMB.2.raw
  modified_base (417)..(417): a, c, t, g, unknown or other
  modified_base (444)..(444): a, c, t, g, unknown or other
  modified_base (508)..(508): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaacctgtttcccatcgactacgcctttcggcctcgccttaggggtcactcaccctgccccgattaacgttggacaggtaacccttggtcttccggcgagcgggtcttttcgacccgtacgtttatcgttacttatgtcagtcattcgcncttctgatacctccagcatgcctcacngcacaccttcacacggcttacagaacgcctacccctacccaacaaacgcaataacgcgtcgccncgtccgcgcgtcgtcggtcgcgtacgttcggtttaccgttcccgtttccgttcttcccttccctccctctctcgttacgtcgttaacgtaacg

SEQ ID NO: 393201 - DNA, 620 bp, Homo sapiens
  misc_feature: GZ8MTXP01DYND5.15.57.F02.1.454.CMB.2.raw
  modified_base (389)..(389): a, c, t, g, unknown or other
  modified_base (400)..(400): a, c, t, g, unknown or other
  modified_base (445)..(445): a, c, t, g, unknown or other
  modified_base (470)..(470): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttagggcactcaccctgccccgattaacgtggacaggaacccttggtcttccggcgagccgggctttcgacccgtacgtttacncgttacttagngtcagcattcgctaacttctgactacctccagtcatgctcacacncacactcacacgactacacgaaccnccctacccctaacccaaacaaccgacaagtaacgaccgtccgccgtcgtccgaccgcgtcgttcggtcgttcgtacgttacggtttaccgttcccgtttccgttccttcccttcccgtcctaacgtcgtcgttacgtcgttaacgtaacg

SEQ ID NO: 393202 - DNA, 586 bp, Homo sapiens
  misc_feature: GZ8MTXP01DY0S7.15.57.F02.1.454.CMB.2.raw
  modified_base (375)..(375): a, c, t, g, unknown or other
  modified_base (434)..(434): a, c, t, g, unknown or other
  modified_base (556)..(556): a, c, t, g, unknown or other
tcagtctacgtagccacgaccggtgctcgatttagctcgatatagttgggttttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaaacatagccttctcccgtcccccttcgcagtacacaagtacagaatataacctgttccatcgactacgccttcggcctcgcctagggtcactcaccctgccccgattaacgttggacaggacccttggcttccggcgagcgggtcttttcacccgtntttatcgtttacttatgtcagcattcgctaactttctgatcctccagcatgcctcacancacacctcacagacttacaacgaccgacctacccctaccaaacaaccgacaactaacgcgtcgctgccgcacgcttcggtgcgtacgtttcggtttacgccccgtttcttcttcctttcccnctaactctcgacgtaaccgttaacgtaacg

SEQ ID NO: 393203 - DNA, 587 bp, Homo sapiens
  misc_feature: GZ8MTXP01EMPHQ.15.57.F02.1.454.CMB.2.raw
  modified_base (377)..(377): a, c, t, g, unknown or other
  modified_base (406)..(406): a, c, t, g, unknown or other
  modified_base (436)..(436): a, c, t, g, unknown or other
  modified_base (464)..(464): a, c, t, g, unknown or other
  modified_base (509)..(509): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacagaatattaacctgttcccatcgactacgccttcggcctcgcttagggtcactcaccctgccccgattaacgtggacaggacccttggtcttcggcgagcgggtcttttcgacccgtntttactcgttacttatgtcagcattcgcnctttctgactcctccagcatcgcctcacancacaccttcacaggcttacacgaacccnccctacccaacccaaacaaccgacaactacgcgtcgctcgccgcncgcgtcgtcgcgtacgttcggttcgtcccgttccgttcttcccttcccgtcctctctcgttacgtcgttaacgtaacg

SEQ ID NO: 393204 - DNA, 602 bp, Homo sapiens
  misc_feature: GZ8MTXP01ED4QY.15.57.F02.1.454.CMB.2.raw
  modified_base (436)..(436): a, c, t, g, unknown or other
  modified_base (438)..(438): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccggggacaaccgtcgcccggccaacatagccttctccgtcccccttgcagtaacaccaagtacaggaatattaacctgtttcccatcgactacgcctttcggcctcgccttaggggcactcaccctgccccgtattaacgtggacaggaacccttggtcttccggcgagcgggtcttttcgaccgcgtttatcgttacttatcgtcagcattcgctaacttctgactacctccagcatcncncacacacacactacacacgactacacgaacacctacccctaacccaaccaaccacaacaacgacgtccgcgcgtccgccgacgtcgtcgtcgttctacgttcggttaccgtcccgttccgttcttccttccctcctaactctacgacgtaacgttaacgtaacg

SEQ ID NO: 393205 - DNA, 590 bp, Homo sapiens
  misc_feature: GZ8MTXP01CZIF5.15.57.F02.1.454.CMB.2.raw
  modified_base (275)..(275): a, c, t, g, unknown or other
  modified_base (346)..(346): a, c, t, g, unknown or other
  modified_base (421)..(421): a, c, t, g, unknown or other
  modified_base (429)..(429): a, c, t, g, unknown or other
  modified_base (458)..(458): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctccgtccccccttcgcagtaacaccaagtacagaatattaacctnttccatcgactacgccttcggcctcgccttagggcactcacctgcccgatacgtgacagacctgtctcggngagcgggtctttcgaccgctttactcgttacttatgtcagctattccgctaacttctgtactaccctcagcatcncctcacanccacaccttcacacgcttacacgaacccncctaccccaacccaacaacgcaatacgcgtcgactcgccgcacgtcgttcggtcgactacgttccggtttaccgtcccctttcgttccttccctccccgcctaacgtcgtaggacgtccgttaacggtaacg

SEQ ID NO: 393206 - DNA, 609 bp, Homo sapiens
  misc_feature: GZ8MTXP01EAAGG.15.57.F02.1.454.CMB.2.raw
  modified_base (361)..(361): a, c, t, g, unknown or other
  modified_base (461)..(461): a, c, t, g, unknown or other
  modified_base (531)..(531): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtccccccttgcagtaacaccaagtacagaatattaacctgttcccatcgactacgcttcggcctcgcttagggcactcacctgcccgatacgtgacagacctgtctcgcgagcggtctttcaccgtntttatcgttacttatgtcagtcattccgctaacttctagactaccctcagcatcgcctcacacgccaactacccttcactacggacttaacacgaaaccncccttacccccgaaacccaaacaaccgaccaagtaacgcgtcgcctcgcccgctacgtccgttcgggtcncgtacgtttcggtttaaccgtcccccgttttacgaccttcccttccccgcctaatccgtagacgtccttaacgtaacg

SEQ ID NO: 393207 - DNA, 589 bp, Homo sapiens
  misc_feature: GZ8MTXP01CEBG3.15.57.F02.1.454.CMB.2.raw
  modified_base (382)..(382): a, c, t, g, unknown or other
  modified_base (400)..(401): a, c, t, g, unknown or other
  modified_base (404)..(404): a, c, t, g, unknown or other
  modified_base (406)..(406): a, c, t, g, unknown or other
  modified_base (411)..(411): a, c, t, g, unknown or other
  modified_base (417)..(417): a, c, t, g, unknown or other
  modified_base (424)..(424): a, c, t, g, unknown or other
  modified_base (426)..(426): a, c, t, g, unknown or other
  modified_base (497)..(497): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaaccagcctacacgcttaaaaccgggacaaaccgtcgcccggccaaacatagccttctccgtccccccttgcagtaacaccaagtacagaatattaacctgtttcccatcgactacgcctttcggctcgccttaggggtcactcaccctgccccgattaacgtggacaggaacccttggtcttcggcgagcgggcttttcacccgntttatcgttattatgcanntcncnctctnactacncacacancnctcacacacacacctacacacgactacacaacacctaccctaacccaaaccaaccacaacaacgacgcgcncgccgcgcgcgtcgtcgttcgtacgttacgttacgttcccgttccgttcttccttcccgtccctaactctacgacgtaacgttaacgtaacg

SEQ ID NO: 393208 - DNA, 602 bp, Homo sapiens
  misc_feature: GZ8MTXP01BB784.15.57.F02.1.454.CMB.2.raw
  modified_base (432)..(432): a, c, t, g, unknown or other
  modified_base (527)..(527): a, c, t, g, unknown or other
  modified_base (573)..(573): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacagaatattaacctgttccatcgactacgcttcggcctcgcttagggcactcacctgcccgattacgtgacaggtacccttggtcttcggcgagccgggtcttttcaccgtctttatcgttacttatgtcagctattccgctaacgttctagactaccctcagctatcgctcacngaccactaccttcaacacgcttaacacgaacctccctaccccaaccaacaaccgcaactaacgccgtacgcgtcgcccgcacgtcgttccgggtnttacgtacgtttccggttaccgtccccgtttcgccttcccttcccnctaacgtcgtacgacgtcgttaacgtaag

SEQ ID NO: 393209 - DNA, 608 bp, Homo sapiens
  misc_feature: GZ8MTXP01B8Z8Q.15.57.F02.1.454.CMB.2.raw
  modified_base (381)..(381): a, c, t, g, unknown or other
  modified_base (472)..(472): a, c, t, g, unknown or other
  modified_base (566)..(566): a, c, t, g, unknown or other
  modified_base (580)..(580): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattaacgtggacaggacccttggtcttccggcgagcgggctttcgacccgtntttactcgttacttatgtcagcattcgctcttctgactacctcagcatcgcctcacacgcacaccttcgacacggaccttacacgaaaccnccctacccccgtaacccaaacaaccgcaataaacgccgtccgctcgcccgacacgtcttcgggtgcgtacgttcggtttaccgtcccgtttacnccttcccgttcccnctaacgtctcgacgtcgttaacgtaacg

SEQ ID NO: 393210 - DNA, 658 bp, Homo sapiens
  misc_feature: GZ8MTXP01BXAOY.15.57.F02.1.454.CMB.2.raw
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggcaacatacgccttcctcccgtcccccttcgcagtaacaccaagtacagaatattaacctgttccatcgactacgccttcgcctcgccttagggcactcaccctcgccccgtattaacgtgacacggtaacccttggtccttccggcgaggccgggtcttttccgacccgtctttactcgttacttatcgtcagctattcgctcttctagtactaccctcagcatcgcctcacacgccactacccttacacacggtacttacaacgaaccgtccctaccccctaaacccgaaaccaaaccgaccaaactaacgccgtacgcctcgcccgactacgtcgttcggtcgttcgtacgttcgggtttacccgtccccggttttcgttacctttccccgttttcccgcccttaacttccgtacggttaccgtcgttaacccggtaagg

SEQ ID NO: 393211 - DNA, 590 bp, Homo sapiens
  misc_feature: GZ8MTXP01AFV3I.15.57.F02.1.454.CMB.2.raw
  modified_base (347)..(347): a, c, t, g, unknown or other
  modified_base (362)..(362): a, c, t, g, unknown or other
  modified_base (536)..(536): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtccccccttcgcagtaacaccaagtacagaatattaacctgttcccatcgactacgccttcggcctcgcttagggtcactcaccctgcccgattacgtgacagacctgctcgcgngcggctttcaccgtntttactcgttacttatgtcagcattccgctaacttcagactaccctccagcatcgcctcacacgcacaccttcacagcttacacgaaccgcctacccctaaccaacacgacagtacgcgtcgctcgccgcagtcgttcggtcgactacgttcgggtttacgtcccccgtttacnccttcccgtttccccgctaacttcccgtagttacgtaacccgttaaggtaaccg

SEQ ID NO: 393212 - DNA, 597 bp, Homo sapiens
  misc_feature: GZ8MTXP01AY4X2.15.57.F02.1.454.CMB.2.raw
  modified_base (398)..(398): a, c, t, g, unknown or other
  modified_base (404)..(404): a, c, t, g, unknown or other
  modified_base (425)..(425): a, c, t, g, unknown or other
  modified_base (431)..(431): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgatttttccggatttgcctaggaaaaaccagcctacacgacttaaaccgggacaaccgtcgcccggaccaacatacgccttcctcccgtccccccttcgcagtaacacaagtacagaatattaacctgttccatcactacgcttcggctcgcttagggcactcacctgccccgattaacgtggacacggtaccttggtcttcggcgagcgggtctttcgaccgtcgttatcgttacttatgtcancactcnctctctcgtactacctccacncactcnctcacacacactacctacacacgactacacaccaccctaccctaaccaacaaccacactacgtcgcgctcgccgacgcgtcgtcgtcgttcgtacgttcgtttaccgttcccgttccgttccttcccgttcccgtcctaactctcgttacgtaacgttaacgtaag

SEQ ID NO: 393213 - DNA, 659 bp, Homo sapiens
  misc_feature: GZ8MTXP01EK54G.15.57.F02.1.454.CMB.2.raw
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttcctccgtccccccttgcagtaacaccaagtacagaatattaacctgttccatcgactacgcctttcggcctcgccttagggtcactcaccctgccccgattaacgtgacaggaacccttggtcttcggcgacggccgggtctttcgaccgtactttatacgttacttatgtacagctacttcgctaacttcctagtactacccctccgaagcaattcgcccttacacaaccgtaccaaccctaccgtacaacgtacgtacctaaaccgacgaaccccgtacccctaacccccgtaaacccaaaccgaaccgacaacgtaaccggccgtcgcgtcgtccgacgtcgtcgtcggtcgttcgtacgttacggttaccgttcccgttccgttccttcctccctcctctcgtcgttacgtaacgttaacgtaacg

SEQ ID NO: 393214 - DNA, 249 bp, Homo sapiens
  misc_feature: GZ8MTXP01BSL1H.15.57.F02.1.454.CMB.2.raw
  modified_base (249)..(249): a, c, t, g, unknown or other
tcagtctacgtagccacgaccggtgctcgatttagctcgatatagttgggtttggggggtgtggtggtctccactcccgccttgacgaggctgattattactgccactcatatagaagtagtactactcctgtggttttcggcggagggaccaagctgaccgtcctaggtcagcccaaggctgccccctggtcactctgttcccgccctcctcgctacgtagactgagcgggctggcaaggcgcatagn

SEQ ID NO: 393215 - DNA, 576 bp, Homo sapiens
  misc_feature: GZ8MTXP01DGLK1.15.57.F02.1.454.CMB.2.raw
  modified_base (180)..(180): a, c, t, g, unknown or other
  modified_base (427)..(427): a, c, t, g, unknown or other
  modified_base (440)..(440): a, c, t, g, unknown or other
  modified_base (454)..(454): a, c, t, g, unknown or other
  modified_base (486)..(486): a, c, t, g, unknown or other
  modified_base (506)..(506): a, c, t, g, unknown or other
  modified_base (533)..(533): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttcctccgtccccccttgcagtaacaccaagtacagaatattaacctgttcccatcgactacgccttcggcctcgccttagggcactcacctgccccgattacgtgacaggacctgtctcggcagcggtctttcaccgtctttatcgttacttatgtcagctattcgctaacttctgactaccctcagcatcgcctcacngcacaccttcacngacctacacgaacncctaccccaaccaacaacgcaataacgcgtcnctcgccgccagccttcggtncgtagttcggttaaccgtccccgtttnaccttcccttcccgcctaacttcacgacgtccgttaacgtaag

SEQ ID NO: 393216 - DNA, 617 bp, Homo sapiens
  misc_feature: GZ8MTXP01A75V5.15.57.F02.1.454.CMB.2.raw
  modified_base (357)..(357): a, c, t, g, unknown or other
  modified_base (374)..(374): a, c, t, g, unknown or other
  modified_base (430)..(430): a, c, t, g, unknown or other
  modified_base (432)..(432): a, c, t, g, unknown or other
tcagtctacgtagccacgaccggtgctcgatttagctcgatatagttgggtttggggtacgatttgatgttacctgatgcttagaggcttttcctggaagcagggcatttgttgtttcagcaccgtagtgcctcgtcatcacgcctcagccttgatttttccggatttgcctggaaaaccagcctacacgcttaaaccgggacaaccgtcgcccggccaacatacgccttctccgtccccccttgcagtaacaccaagtacaggaatattaacctgtttcccatcgactacgcctttcggcctcgcctagggtcactcaccctgccccgattaacgtgacaggaccctggtctcggngagcggctttcgaccgntttactcgttacttatcgtcagctattcgactactttcatactacctccagcatcncncacacacacactacacacgactacacgaaccacctacccctaacccaacaaccgaccaacgtaacgcgtcgcgcgccgtcgacgtcgtcggtcgtcgttacgttacggtttaccgttcccgttccttaccgttcccttcccgtaacctacgtaacgtacgtacgttacgtaacgttcggtaacgg

SEQ ID NO: 393217 - DNA, 249 bp, Homo sapiens
  misc_feature: GZ8MTXP01A0Z3Z.15.57.F02.1.454.CMB.2.raw
  modified_base (248)..(249): a, c, t, g, unknown or other
tcagtctacgtagccacgaccggtgctcgatttagctcgatatagttgggtttggggggtgtggtggtctccactcccgccttgacgaggctgattattactgccactcatatagaagtagtactactcctgtggttttcggcggagggaccaagctgaccgtcctaggtcagcccaaggctgccccctggtcactctgttcccgcctcctcgctacgtagactgagcgggctggcaaggcgcatagnn

SEQ ID NO: 393218 - DNA, 590 bp, Homo sapiens
  misc_feature: GZ8MTXP01EGA93.15.57.F02.1.454.CMB.2.raw
  modified_base (396)..(396): a, c, t, g, unknown or other
  modified_base (418)..(418): a, c, t, g, unknown or other
  modified_base (473)..(473): a, c, t, g, unknown or other
  modified_base (502)..(502): a, c, t, g, unknown or other
  modified_base (509)..(509): a, c, t, g, unknown or other
  modified_base (521)..(521): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgttcccatcgactacgccttcggcctcgccttaggggtcactcaccctgccccgattaacgtggcaggaacccttggtcttccggcgagcgggtcttttcacccgtctttatcgttacttanggtcagcattccgctaactttntgaactaccctccagcaatcgcctcacagcacaccttcacaggcttacagaaccnctacccctaccaacaacgcataagcgtcncctgccncacgctcgggtnccgattcggtttacgtccccttcgttcttcccttccccgcctaactcttcgacgtccgttaacgtaacg

SEQ ID NO: 393219 - DNA, 636 bp, Homo sapiens
  misc_feature: GZ8MTXP01EB2LO.15.57.F02.1.454.CMB.2.raw
  modified_base (369)..(369): a, c, t, g, unknown or other
  modified_base (406)..(406): a, c, t, g, unknown or other
  modified_base (494)..(494): a, c, t, g, unknown or other
  modified_base (546)..(546): a, c, t, g, unknown or other
  modified_base (548)..(548): a, c, t, g, unknown or other
  modified_base (560)..(560): a, c, t, g, unknown or other
  modified_base (589)..(589): a, c, t, g, unknown or other
  modified_base (607)..(607): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaacccgtcgcccggccaacatagccttcctccgtccccccttcgcagtaacaccaagtacaggaatattaacctgttcccatcgactacgccttcggcctcgccttagggtcgacctcaccctcgccccgtattaacgttggacacggtaacccttggtcttccggngtagcgggtcttttcgaccgtctttatcgttacttangtcagctattccgctaacttctgactaccctcgagctactcgcctcgacagccactaccttacaccaggaccttaaccacggtaaccncccctaccccctaaccccaaacaacgaccactaacgccgttcgcctcggccncncgccttcggtcncgtacgtttcggttaccgtccccgtttcnccgttcccgttaaccccncctctccgtagttacgtcgttaacgtaag

SEQ ID NO: 393220 - DNA, 592 bp, Homo sapiens
  misc_feature: GZ8MTXP01A44ZP.15.57.F02.1.454.CMB.2.raw
  modified_base (284)..(284): a, c, t, g, unknown or other
  modified_base (376)..(376): a, c, t, g, unknown or other
  modified_base (393)..(393): a, c, t, g, unknown or other
  modified_base (522)..(522): a, c, t, g, unknown or other
  modified_base (534)..(534): a, c, t, g, unknown or other
  modified_base (555)..(555): a, c, t, g, unknown or other
  modified_base (576)..(576): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggcaacatagccttctccgtcccccttgcagtaacaccaagtacagatataacctgttccatcgactacncttcgctcgcttagggcactcacctgccccgtattaacgttggacaggtaacccttggtaccttccggcgacgcgggtcttttcgacccgtntttagtcgttacttagngtcagcattcgctcttctgactacctcagtcatcgcctcacagcactaccttcacacggtaccttacacgaaacctcccacccccgtaaacccaaacaaccacgtaactaacgccgtcgctcgcccganacgtctcgggtnctacgttgttaccgccctttncttcccttaaccgcctaatcngacgtcttaacgtaag

SEQ ID NO: 393221 - DNA, 555 bp, Homo sapiens
  misc_feature: GZ8MTXP02I36X1.15.57.F02.1.454.CMB.2.raw
  modified_base (354)..(354): a, c, t, g, unknown or other
  modified_base (400)..(400): a, c, t, g, unknown or other
  modified_base (490)..(490): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgttgcccggccaacatagccttctccgtcccccttcgcagtaacaccaagtacaggaatattaacctgttcccatcgactacgcctttcggcctcgccttaggggtcgactcaccctgccccgattaacgtgacaggacctgctcggngagcgggctttcacccgctttatcgttacttatgtcagcattcgcncttctgatacctccagcatcgcctcacagcacacttcacagctacagaaccgcctccctaacccaacaacgcaataaacgcgtacgctcnccgcacgctcgtgcactgttacgtccgttcctactcttcccgtccactctcgacgtctacgtacg

SEQ ID NO: 393222 - DNA, 549 bp, Homo sapiens
  misc_feature: GZ8MTXP02ITL7F.15.57.F02.1.454.CMB.2.raw
  modified_base (463)..(463): a, c, t, g, unknown or other
tcagtctacgtagccacgaccggtgctcgatttagctcgatatagttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactatgcctttcggcctcgccttaggggtcgactcaccctgcccccgattaacgttggacaggaaccccttggtcttccggcgagcgggctttcgaccgctttatcgttaccttatgtcagcattcgcacttctgatacctcagcatgcctcacagcacaccttcacagcttacagaacnctcccctaccaacacgccataagcgtcgctgccgcagcttcgtgcatgtttacgcccgtttcatcttcccgcactctgacgctacg

SEQ ID NO: 393223 - DNA, 249 bp, Homo sapiens
  misc_feature: GZ8MTXP02FNWKY.15.57.F02.1.454.CMB.2.raw
  modified_base (248)..(249): a, c, t, g, unknown or other
tcagtctacgtagccacgaccggtgctcgatttagctcgatatagttgggtttgggggtgtggtggtctccactcccgccttgacgaggctgattattactgccactcatatagaagtagtactactcctgtggttttcggcggagggaccaagctgaccgtcctaggtcagcccaaggctgccccctggtcactctgttcccgccctcctcgctacgtagactgagcgggctggcaaggcgcatagnn

SEQ ID NO: 393224 - DNA, 557 bp, Homo sapiens
  misc_feature: GZ8MTXP02IDMNV.15.57.F02.1.454.CMB.2.raw
  modified_base (408)..(408): a, c, t, g, unknown or other
  modified_base (487)..(487): a, c, t, g, unknown or other
  modified_base (503)..(503): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgccggccaacatagccttctccgtccccccttcgcagtaacaccaagtacaggaatattaacctgttcccatcgactacgcctttcggcctcgcctaggggtcacggtcaccctgccccgattaacgttggacagaacccttggtctcggcgagcgggcttttcacccgctttatcgttacttactgtcagcattcgcncttctgatacctccagcatgcctcacagcacaccttcacaggcttacagaacgctcccctaccaacacgcatagcgtcnctgccgcagcttcggngcactggttacgccccgtttcactccttcccgcccatcctgacgctacgtaacg

SEQ ID NO: 393225 - DNA, 581 bp, Homo sapiens
  misc_feature: GZ8MTXP02G293Y.15.57.F02.1.454.CMB.2.raw
  modified_base (408)..(408): a, c, t, g, unknown or other
  modified_base (462)..(462): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtggacaggacccttggtcttcggcgagcgggcttttcacccgtctttatcgttacttatgtcagcattcgcncttctgataccctccagcatgcctcacagcacaccttcacagcttacacgaacncctacccctaacccaacaacgcaataaacgcgtacgctcgcccgcagccttcggtgctacgttcggttacgcccccgtttcacgttccttcccgccacttcctgactcgtacggtaacg

SEQ ID NO: 393226 - DNA, 590 bp, Homo sapiens
  misc_feature: GZ8MTXP02JJL4A.15.57.F02.1.454.CMB.2.raw
  modified_base (383)..(383): a, c, t, g, unknown or other
  modified_base (412)..(412): a, c, t, g, unknown or other
  modified_base (417)..(417): a, c, t, g, unknown or other
  modified_base (441)..(441): a, c, t, g, unknown or other
  modified_base (462)..(462): a, c, t, g, unknown or other
  modified_base (482)..(482): a, c, t, g, unknown or other
  modified_base (489)..(489): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtggacaggaacccttggtctccggcgagcgggtctttcgacccgtntttactcgttacttatgtcagcattcgcncttcngactacctccagcatgcctcacancacactcacagctacacgacncctacccaccaacacacaanacgcgcnctcgccgacacgtcttacggtgctacgttcggttaccgtcccgtttactaccttcccgttaaccccgtacctacgttcgtacgtacgtccgttaacgtacg

SEQ ID NO: 393227 - DNA, 593 bp, Homo sapiens
  misc_feature: GZ8MTXP02G6XSM.15.57.F02.1.454.CMB.2.raw
  modified_base (412)..(412): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgtggacacggaaccttggtcttccggcgagcgggcttttcgacccgtctttatcgttacttatgtcagcattcgcncttctgactaccctcagcatgcctcacagcacaccttcacacggcttacacgaaacgcctacccctacccaacaaccgcaataacgccgtcgctcgcccgtcacgtccttcggtcgcgtagttcgggttactcccccgtttacaccttccttccccgcctactcctgacgtcctaacgtag

SEQ ID NO: 393228 - DNA, 590 bp, Homo sapiens
  misc_feature: GZ8MTXP02JSE1B.15.57.F02.1.454.CMB.2.raw
  modified_base (466)..(466): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcacctgccccgataacgtgacaggacctggtctcggcgagcgggtcttttcacccgtctttatcgttacttactgtcagctattccgctcttctgactaccctccagcatcgccctcacacgcacaccttcacaggcttacagaaccncctaccccctaaccaacacgacaataacgccgtcgactcgacccgcacgtccgttcggtgcctagttcggtttacgtcccccgtttcacttccttccccgcacgtcctgacgtacgtacgtacg

SEQ ID NO: 393229 - DNA, 248 bp, Homo sapiens
  misc_feature: GZ8MTXP02G795O.15.57.F02.1.454.CMB.2.raw
  modified_base (248)..(248): a, c, t, g, unknown or other
tcagtctacgtagccacgaccggtgctcgatttagctcgatatagttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgcctcctcgctacgtagactgagcgggctggcaaggcgcatagn

SEQ ID NO: 393230 - DNA, 560 bp, Homo sapiens
  misc_feature: GZ8MTXP02IWB33.15.57.F02.1.454.CMB.2.raw
  modified_base (378)..(378): a, c, t, g, unknown or other
  modified_base (383)..(383): a, c, t, g, unknown or other
  modified_base (392)..(392): a, c, t, g, unknown or other
  modified_base (405)..(405): a, c, t, g, unknown or other
  modified_base (458)..(458): a, c, t, g, unknown or other
  modified_base (512)..(512): a, c, t, g, unknown or other
  modified_base (551)..(551): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggtcgactcacccctgccccgattaacgtgacaggacccttggtcttccggcgagcgggctttgcccngttcncgtacttangtcagcattcgcncttctgactacctccagcatcgcctcacagcacaccttcacagctacagaacncctcccctacccaacaaccgcactaacgccgtcgctcgccgcacgcgtcgtgcngtcgttacgtcccgttcctctcttccgtccactctgacnctacgtacg

SEQ ID NO: 393231 - DNA, 577 bp, Homo sapiens
  misc_feature: GZ8MTXP02JDC0A.15.57.F02.1.454.CMB.2.raw
  modified_base (382)..(382): a, c, t, g, unknown or other
  modified_base (410)..(410): a, c, t, g, unknown or other
  modified_base (439)..(439): a, c, t, g, unknown or other
  modified_base (514)..(514): a, c, t, g, unknown or other
  modified_base (541)..(541): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtggacaggacccttggtcttccggcgagcgggcttttcacccgtntttatcgttacttatgtcagcattcgcncttctgactaccctcagccatgcctcacngcacaccttcacagcttacagaaccgcctcccctacccaacaacgcaataacgcgtcgctgccgcagccttcggngcagttcggtttacgcccccgttttanccttcctcccgctactcgtagtactacgtacgtacg

SEQ ID NO: 393232 - DNA, 570 bp, Homo sapiens
  misc_feature: GZ8MTXP02HAH1D.15.57.F02.1.454.CMB.2.raw
  modified_base (408)..(408): a, c, t, g, unknown or other
  modified_base (514)..(514): a, c, t, g, unknown or other
  modified_base (527)..(527): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcgactcaccctgccccgattaacgtgacaggacccttggtcttcggcgagcgggctttcgacccgtctttatcgttacttatgtcagcattcgcncttctgactacctccagcatcgcctcacagcacaccttcaacaggcttacagaaaccgcctaccccaccacaacgcaataacgcgtacgctcgccgacagcttcgngcacttggttacnccccgtttcacttccttcccgctactctagacgtcctagtacg

SEQ ID NO: 393233 - DNA, 579 bp, Homo sapiens
  misc_feature: GZ8MTXP02FKJG2.15.57.F02.1.454.CMB.2.raw
  modified_base (416)..(416): a, c, t, g, unknown or other
  modified_base (463)..(463): a, c, t, g, unknown or other
  modified_base (506)..(506): a, c, t, g, unknown or other
  modified_base (517)..(517): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtggacaggaacccttggtcttccggcgagcgggtctttcacccgctttatcgttacttatgtcagcattccgctcttcngactaccctccagcatgcctcacagcacacctcacagctacagaacncctacccctacccaacaaccgcaataaacgcgtcgctcgcccncgagcttcggnctacgttggtttaacgcccccgtttcacttccttcccgcctactcctgacgcctaacgtacg

SEQ ID NO: 393234 - DNA, 617 bp, Homo sapiens
  misc_feature: GZ8MTXP02JZEFB.15.57.F02.1.454.CMB.2.raw
  modified_base (437)..(437): a, c, t, g, unknown or other
  modified_base (469)..(469): a, c, t, g, unknown or other
  modified_base (546)..(546): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcacccctgccccgattaacgtgacaggaccctgtctcggcgagcgggctttcaccgctttatcgttacttatgtcagcattcgcacttctgactacctccagcatcgccctcacgacncaaccaccttcactaggcttacaacgaaaccnccctaccccctaacccaaacaaaccgtccaaagtaaacgccggttccgcctggcccccgataacgctttcccggggntccgtagtttccgggttacctccccgtttactaccgttcctccccgctactcgtacgactcgtaacgtacg

SEQ ID NO: 393235 - DNA, 606 bp, Homo sapiens
  misc_feature: GZ8MTXP02JQLP9.15.57.F02.1.454.CMB.2.raw
  modified_base (411)..(411): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgtggacaggacccttggtcttccggcgagcgggcttttcgacccgctttatcgttacttatgtcagcattcgcncttctgactacctcagcatgcctcacagcacaccttcacaggcttacagaaccgcctacccctaccaacacgcaactaacgccgtcgctcgcccgacacgtccttcgggtcacctacgttacggtttaccgtcccccgtttacacgttcccttccccggccctaacgttcctggaacgtcccgttaacggtaacg

SEQ ID NO: 393236 - DNA, 641 bp, Homo sapiens
  misc_feature: GZ8MTXP02FHCIV.15.57.F02.1.454.CMB.2.raw
  modified_base (551)..(551): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccggacaaccgtcgcccggccaacatagccttctcccgtccccccttcgcagtaacaccaagtacaggaatattaacctgtttcccatcgactacgccttcggcctcgccttaggggtcactcaccctgccccgattaacgttggacacggaacccctttggtccttccggcgaggccgggtcttttcgaccccgtctttatcgtttactatgtcagcattccgctaccttctcgacttaccctccaagccaatcgccctcacagcaaccacccttcaacaggccttaacacgaaacccgcctacccccacccaacgaccgcaatacgcgtcgctcgccgacacgtcttcggggcncctaacgttcgggttttaaccgccccccgtttttacaacctttcccgttcccccggcctaactccctggaccggtacctacggtaaacgg

SEQ ID NO: 393237 - DNA, 382 bp, Homo sapiens
  misc_feature: GZ8MTXP02H5LDP.15.57.F02.1.454.CMB.2.raw
  modified_base (374)..(374): a, c, t, g, unknown or other
  modified_base (380)..(382): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggaccaacatacgcccttcctcccgtcccccttgcagtaacaccaagtacagaatataactgttccatcgactacgcctttcgcctcgccgtagggtcactcacctcgccccgattaacgtgacacgacctggtctccggcgagcgggctggcaaggcncatagnnn

SEQ ID NO: 393238 - DNA, 248 bp, Homo sapiens; identical to SEQ ID NO: 393229
  misc_feature: GZ8MTXP02GY0JS.15.57.F02.1.454.CMB.2.raw
  modified_base (248)..(248): a, c, t, g, unknown or other

SEQ ID NO: 393239 - DNA, 596 bp, Homo sapiens
  misc_feature: GZ8MTXP02GEGBP.15.57.F02.1.454.CMB.2.raw
  modified_base (376)..(376): a, c, t, g, unknown or other
  modified_base (427)..(427): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcacctgccccgataacgtgacaggaccctggtctcggcgagcgggctttcaccgcttancgttacttatcgtcagtcattcgctacttctgtactacctccagtccatcncctcacacgctaaccacctacacacgacttacacgaaccaccctaccccaacccaaacaaccgacaactaacgccgtacgctcgccgacacgtcgtcgtcgcgacgttacgttacgttacccgttcctaccttccttcccgtcctactctacgtacgtacgtacgtacg

SEQ ID NO: 393240 - DNA, 582 bp, Homo sapiens
  misc_feature: GZ8MTXP02IZN8M.15.57.F02.1.454.CMB.2.raw
  modified_base (412)..(412): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttagggtcactcacccctgccccgattaacgttggacaggaacccttggtccttccggcgagccggggcttttcacccgctttatcgttacttatgtcagcattcgcncttctgataccctccagcatgcctcacagcacaccttcacagctacagaacgcctacccctaacccaacaaccgcaactaacgcgtcgctcgccgcagtcttcggtgcctagttcggtttacgcccccgttttacacttccttcccgcctatcctgaacgtctaacgtag

SEQ ID NO: 393241 - DNA, 612 bp, Homo sapiens
  misc_feature: GZ8MTXP02G0V2N.15.57.F02.1.454.CMB.2.raw
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcactcaccctgccccgattaacgtggacaggaacctggtcttccggcgaggccgggtcttttcgacccgtctttatcgttactactgtcagcattcgctcttctgactacctccagcatcgcctcacagcaccaccttcacacgcttacgacaaaccgcctacccctaacccaaacaaccgcaactaacgcgtcgctcgcccgcacgtccgtttcgggctcctaagttcggtttaaccgtccccgtttacaccttccgttaaccccgcctactccgttagacgtaccgttaacgtacgg

SEQ ID NO: 393242 - DNA, 581 bp, Homo sapiens
  misc_feature: GZ8MTXP02F1PAM.15.57.F02.1.454.CMB.2.raw
  modified_base (359)..(359): a, c, t, g, unknown or other
  modified_base (406)..(406): a, c, t, g, unknown or other
  modified_base (513)..(513): a, c, t, g, unknown or other
tcagtctacgtagccacgaccggtgctcgatttagctcgatatagttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaacctgttcccatcgactacgcctttcggcctcgccttaggggcactcaccctgccccgattaacgtggacaggaacccttggtcttccggngagcgggcttttcacccgctttatcgttacttatgtcagcattcgcnctctgatacctccagcatgcctcacagcacaccttcacaggcttaccagaaaccgcctcccctaaccgaacaaccgcaataacgcgtcgctgccgcagccttggtcnctattcggttacgtccccgtttactcgttcccttcccgacctacttcgtacgacgtacgtaacgtacg

SEQ ID NO: 393243 - DNA, 577 bp, Homo sapiens
  misc_feature: GZ8MTXP02IXOV7.15.57.F02.1.454.CMB.2.raw
  modified_base (366)..(366): a, c, t, g, unknown or other
  modified_base (397)..(397): a, c, t, g, unknown or other
  modified_base (402)..(402): a, c, t, g, unknown or other
  modified_base (421)..(421): a, c, t, g, unknown or other
  modified_base (423)..(423): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgttcccatcgactacgcctttcgcctcgccttagggcactcaccctgccccgattaacgtgacaggaacccttggctcggcgagcgggctttcnccgctttagctacttatgtcagctattcgcncttcngactaccgtccagccatcncncacacacacacctacacacgactacacgacgacctaccctaacccaaccaacacaacaacgacgcgacgtcgccgacgacgtcgtcgtcgcgtacgtacggttacgtccgttccgtacctcctccgtcctactcgtacgtacgtactacgtacg

SEQ ID NO: 393244 - DNA, 580 bp, Homo sapiens
  misc_feature: GZ8MTXP02GTOI8.15.57.F02.1.454.CMB.2.raw
  modified_base (394)..(394): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacacaagtacagaatattaacctgttcccatcgactacgccttcggcctcgctagggcactcaccctgccccattacgtgacagaccttgtctccggcgagcgggctttcaccgtctttatcgttacttactgtcagctattcgcncttcagtactacctccagcatcgcctcacacgcacctacttcacacggtccttaacaacgaaccgcctaccccctaaccaaacaaccgacaataacgcgtccgctcgccgcgacgcgttcgtcgctacgttacggttacgttcccgttcctacctcctcccgtccactctcgacgacgtacgtacg

SEQ ID NO: 393245 - DNA, 651 bp, Homo sapiens
  misc_feature: GZ8MTXP02F0DRK.15.57.F02.1.454.CMB.2.raw
  modified_base (411)..(411): a, c, t, g, unknown or other
  modified_base (432)..(432): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgttcccatcgactacgcctttcggcctcgccttaggggcactcaccctgccccgattaacgtgacaggaccctggtctcggcgagcgggctttcgacccgtgttatcgttacttagtgtcagcattcgctacttcngtactaccctccagccatccncctacacacgccaacctacccttccaacgtacgtaccttaaaccgacgtaaaccgcccctacccccaaacccaaaccaaaccgactaaagtaaccgccgtacgccgtcggaccgacgtacgtccgttacggtcgacgttacggttccggtttaccgtccccgttttcaccgtttcccgttccccgtacctacttcgtacgtacgtacgttaacggtacg

SEQ ID NO: 393246 - DNA, 574 bp, Homo sapiens
  misc_feature: GZ8MTXP02FWQLF.15.57.F02.1.454.CMB.2.raw
  modified_base (370)..(370): a, c, t, g, unknown or other
  modified_base (446)..(446): a, c, t, g, unknown or other
  modified_base (453)..(453): a, c, t, g, unknown or other
  modified_base (523)..(523): a, c, t, g, unknown or other
tcagtctacgtagccacgaccggtgctcgatttagctcgatatagttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttgcagtaacaccaagtacagaatattaacctgttcccatcgactacgcctttcggcctcgccttaggggtcactcaccctgccccataacgtgacagaccttgcttcggcgagcgggctttcgacccgtntttatcgttactatgtcagctattcgctcttctgactaccctcagcatcgctcacagcacacctcactagctaacngaaaccncctacccctaacaacaacgacaataacgcgtcgctcgccgacacgtccttggcactagttcggtttaccncccccgtttacaccttcctcccgtactacgtctagtacgtacgtacgtacg

SEQ ID NO: 393247 - DNA, 641 bp, Homo sapiens
  misc_feature: GZ8MTXP02FUC6E.15.57.F02.1.454.CMB.2.raw
  modified_base (376)..(376): a, c, t, g, unknown or other
  modified_base (423)..(423): a, c, t, g, unknown or other
  modified_base (440)..(440): a, c, t, g, unknown or other
  modified_base (521)..(521): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttaggggcactcaccctgccccgattaacgtgacaggaccttggtctccggcgagcgggctttcgaccgtnttagtcgttactactgtcagtcattccgctacgttctgacttacccncctagctatcgccctanacacgacactaccgtcacgacgtcttacgacgaaaccctcctaccccaacccaaacaccgactaacgaaacgtcgtacgcncggccaacgcgtccgtttcgggactaccgttagttaccgggttttaaccgtcccccgttttacgtaacccgtttcccgtaacccgtactacgttcgtacggtacgtaccgtaacggtacg

SEQ ID NO: 393248 - DNA, 623 bp, Homo sapiens
  misc_feature: GZ8MTXP02FZ593.15.57.F02.1.454.CMB.2.raw
  modified_base (352)..(352): a, c, t, g, unknown or other
  modified_base (354)..(354): a, c, t, g, unknown or other
  modified_base (371)..(371): a, c, t, g, unknown or other
  modified_base (403)..(403): a, c, t, g, unknown or other
  modified_base (431)..(431): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgacttaaaccgggacaaccgtcgcccggccaacatagccttctcccgtcccccttgcagtaacacaagtacagaatattacctgttcccatcgactcgcctttcggcctcgccgttagggcactccaccctgccccattaacgtgacacggaccttggtctcgngngcgggtctttcgacctnttatcgttactatcgtcagctattcgctcttncgactaccctcagcatcgcctacacganaccacctaccttcacgtagtcttaacacgtaaaccctcccctaacccctaaccccaaacaaccgacaacgtaaaccggccgtacgcctcggcccagtaccgtcgttaccggtgtacttacggttaccgggtttacctccccgtttacactttccccgtccccgctacgtctacgtacgtaccgtacgtaacg

SEQ ID NO: 393249 - DNA, 618 bp, Homo sapiens
  misc_feature: GZ8MTXP02JQMI5.15.57.F02.1.454.CMB.2.raw
  modified_base (349)..(349): a, c, t, g, unknown or other
  modified_base (364)..(364): a, c, t, g, unknown or other
  modified_base (459)..(459): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtccccccttgcagtaacacaagtacaggaatattaacctgttcccatcgactacgcctttcggcctcgccttagggtcactcaccctgcccgatacgtgacagacctgctcgcgngcggtctttcacctntttactcgttactactgtcagtctacttcgctacttctgactaccctcagcatcgcctgacagcaactaccttcacgacgtcttacacgaaaccnccctacccctaaccaaccaaacgtcaagtaacgcgtcgactcgcccgcacgtccgttcgggtctaccgtacggtttacgggtttaacccgtcccccgttttaccgtacctttccccgttcccgacctacgttaccgtagtaccgtaccgttaacgtacg

SEQ ID NO: 393250 - DNA, 709 bp, Homo sapiens
  misc_feature: GZ8MTXP02FOBP2.15.57.F02.1.454.CMB.2.raw
  modified_base (465)..(465): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatacgccttctcccgtcccccttcgcagtaacaccaaagtacaagaatattaacctgtttcccatcgaactacgcctttcggcctcgccttaggggcacctccacccctgacccccgtatttaacggtaggacgtacggtaacccctttggtcccttccgggcggtaacggcccggggtcttttacggaccccgtacgtttactccgtttaacttaccgtgtacacgtctagtccactacttcncgtactacctccgagctactcgtaccctacacacgacctaacctacccgttaccgaacgtacggtaccttaaaccgaccgaaacccgtaccctaacccccgaaacccaaacccaacgtacctaacgtaaccgtcgtccgtctacgccgtacgacgtcgttcggtcgtcgtacgttacggttaccgttacccgttacctaccgtacccgtccgtcctaccgtactacgtacgtacgtaacgtacg

SEQ ID NO: 393251 - DNA, 608 bp, Homo sapiens
  misc_feature: GZ8MTXP02JXHRD.15.57.F02.1.454.CMB.2.raw
  modified_base (397)..(397): a, c, t, g, unknown or other
  modified_base (404)..(404): a, c, t, g, unknown or other
  modified_base (510)..(510): a, c, t, g, unknown or other
tcagtctacgtagccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccggacaaccgtcgcccggcaacatagccttctccgtcccccttcgcagtaacaccaagtacaggaatattaacctgttcccatcgactacgcctttcggcctcgccttaggggtcactcacctgcccgattacgtgacagtaccttggcttccggcgagcggtctttcgacctctttatcgttacttagtcgtcagctanaccgtcncttcgctacacctccagcacgtcgactcacagtccacctacttcactagacttacacgacgtccctacccgaacccacaacgcaacgtaccgccgtcgccgcgccncgtacgtccttcggtcgtcgtacggtttacggtttacccgcccgtttcctaccgtttcccgtcccgtacctacgttccgacgtacgtacgttaacgcg

SEQ ID NO: 393252 - DNA, 614 bp, Homo sapiens
  misc_feature: GZ8MTXP01CDBCU.13.79.H02.1.454.CMB.2.raw
  modified_base (279)..(279): a, c, t, g, unknown or other
  modified_base (358)..(358): a, c, t, g, unknown or other
  modified_base (567)..(567): a, c, t, g, unknown or other
  modified_base (594)..(594): a, c, t, g, unknown or other
  modified_base (599)..(599): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtggttttcctgttgctatttagaggtgtcagtgtgaggtgcagctggtggagtcgtgggggaggcttggtccagccgtgggggtccctgagactctcctgtgcagcctcgtggattctacctttagngctagttggatgagtcgtcgggtccgccgaggcctccggaagggggaagggggctgggaggtgggggtacggaccaaanaagtaaaaggctaaaggtttcggaaagttaggaacgtaaaatataaagtggtggacttcgtagggtagaacggggccgtattcccaacctattcctaccaggaagaaccaaacgacctaaagaacctcacttgtaatcagggaactaaagtcgaaacacgccagaaggcgccggaaggtaccacgggtctggtacttagtacgttgcgngaaggttgaggttgggggagtaaggtnacggntaagggttcgaaccg

SEQ ID NO: 393253 - DNA, 537 bp, Homo sapiens
  misc_feature: GZ8MTXP01AL6QD.13.79.H02.1.454.CMB.2.raw
  modified_base (340)..(340): a, c, t, g, unknown or other
  modified_base (490)..(490): a, c, t, g, unknown or other
  modified_base (498)..(498): a, c, t, g, unknown or other
  modified_base (522)..(522): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggctccgaggggagggctgggagtgggtgccaanataaagcaaggttggaagtgaagaaatactaatgtggactgtgtggaagggccgattcacctatcctccaagacgacaacgccaagaactcactgtatctggacaaatgaaacagcctgagacgccgaggacacggctggtcttatacgngtgcgagngaggttgggggacgtaagggttanaggctaaggttgaac

SEQ ID NO: 393254 - DNA, 608 bp, Homo sapiens
  misc_feature: GZ8MTXP01ANQQA.13.79.H02.1.454.CMB.2.raw
  modified_base (333)..(333): a, c, t, g, unknown or other
  modified_base (340)..(340): a, c, t, g, unknown or other
  modified_base (369)..(369): a, c, t, g, unknown or other
  modified_base (438)..(438): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtggttttcgtgtagctatttagaaggtgtcagtgtgaggtgcagctggtggagtcgtgggggaggcttggtccaggccgtggggggtccctgagactctcctgtgcagcctctggattcacctttagagctattggatgagcgtgggtccgccaggctcgaggggagggctgggagtgggngaccaanagtaaagcaagttggaagtgaagaaactntaaatgtggactcgtggtgaaggggcctattcaaccctattccaccagaacgacctaaacggccaaaanacctcatgtactcgaggaactaaagtacgaacgacgcgtacggacggacggaccggacggacgaccggtcgtcgttacgttacgttacgttaggtacggtacggagggttagggttagggtaagggggtacggggtaagggtaaggtaggacggtaacggttcggtaacg

SEQ ID NO: 393255 - DNA, 591 bp, Homo sapiens
  misc_feature: GZ8MTXP01AWNIO.13.79.H02.1.454.CMB.2.raw
  modified_base (345)..(345): a, c, t, g, unknown or other
  modified_base (437)..(437): a, c, t, g, unknown or other
  modified_base (541)..(541): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcacctttagagctattggatgagctgggtccgccaggcctccgaggggaggggctgggagtgggtgccaaanataaagcaaggttggaagtgaagaaatactaatggtgactctggtagaagggccgtattcaccatcctccagacgacaaacgccaaagaccncaactgtactctaggactaaatgaaaccagccctaggacgaacggcccgaagggtaccacggggcttggttccttaagttacccgttggtcggacggttaaggnggttaggttggggggacgaaagggttatacgggctaagggttcgggaacc

SEQ ID NO: 393256 - DNA, 818 bp, Homo sapiens
  misc_feature: GZ8MTXP01AHBV6.13.79.H02.1.454.CMB.2.raw
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctggagactctcctgtgcacgcctcgtggtacttctacctttagagtctagttggatgacgtcgtcgggtcccgccgacggccgtccggagggggaacgggggcgtgggggtagggtcgggggtacggacccgaaacgtaaagtaaaacggacgtaaaggtttagggaaaggtaggaaaagtaaaattaacgttaaagttagggttcggtaccgttacggttagggtacgggaaacgggggtaccgtaacgtttacccgaaccctattcccgaacccgaaagggaaccgaaacccaaaaccccggacccaaaaaggtaaccccttaccgaacgtttacggttacttaacccgtaggaaaccgtaaaagttacgaaaccgtaccggacccgtaggaaacggaccgggaacccggaaggggtaacccgtccggggtaccttaacggttaacccttttaaggtttaacccggttgggttacgggaacggaaagggttacgggttaaggggttaacggggggaaacggtaaagggtttacgaacgggttaccgtaaaggggttccggttaaaacccgg

SEQ ID NO: 393257 - DNA, 724 bp, Homo sapiens
  misc_feature: GZ8MTXP01CI7AQ.13.79.H02.1.454.CMB.2.raw
  modified_base (180)..(180): a, c, t, g, unknown or other
  modified_base (471)..(471): a, c, t, g, unknown or other
  modified_base (640)..(640): a, c, t, g, unknown or other
tcagtcacgtactacacgaccggtgctcgatttagtgtcacacgaagggaaaggggtctcagagaggagccttagccctggactccaaggcctttccacttggtgatcagcactgagcacagaggactcaccatggaattggggctgagctggttttccttgttgctattttagaaggtntccagtgtgaggtgcagctggtggagtcgtgggggagcttggtccgagccgtcgggggtccctgagactctccgtgtgcacgtcctcgtggtacttcctacctttagagtcttagttggattggacgccgtcggggtcccgcccgagggtcctacccggaagggggtaacgggggcgtggggaggtgggggtcggaaccaaacgaataaacggcgtaaaggtttacggaagtggaaagtaaatacgtaatggtggactcgtggtagggacgggacctagttccaaacccgnttccgaccgagtaaacaacccgaaacgtaccaaaacgtcctactaagttagtacttcggaacgaaacttaaacgcgaaaccgcgtcccgaagggaacgaccgggacccggaaaggttacccctaggggtcttaagtttcccgttaagtttaacccgttgggaaaccggnggttaaccgggttgggttaaccggggtttaacggggggacggttaaagttagggaacgccggtttaagcgggggtttaaacccc

SEQ ID NO: 393258 - DNA, 699 bp, Homo sapiens
  misc_feature: GZ8MTXP01EPDSN.13.79.H02.1.454.CMB.2.raw
  modified_base (280)..(280): a, c, t, g, unknown or other
  modified_base (305)..(305): a, c, t, g, unknown or other
  modified_base (520)..(520): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtggtttcctgtgctatttagaggtgtcagtgtgaggtgcagcgtggtggagtcgtgggggaggcttggtccagccgtggggggtccctgagactctctgtgcacgcctcgtggtattctacctttagngtctagttggatgagcgtgggtccncgaggctccggaggggaaggggctgggaggtgggggtcgaccaaataagtaaaggacgtaaaggttaggaaggtagaaagtaaatacgtaagtggtggtacctgtagggtaggaaacggggtccgtattacccactactcctaccgagaacggaaccaaccggacaaacgtacctacgacttagtactccgtaggaaactaaagtacgaaaccgngcccgtaaggaagaacccggaccggtaaacgggtaccgaccgggttccttaaggttaccctttaagtttacgtttaaggggacggaacgggttaaggttaacggggttaacgggggttaaggggggaaacggttaaagggtacgtaacgggacgggttaacgggttaacggtaaccccg

SEQ ID NO: 393259 - DNA, 637 bp, Homo sapiens
  misc_feature: GZ8MTXP01EU41T.13.79.H02.1.454.CMB.2.raw
  modified_base (254)..(254): a, c, t, g, unknown or other
  modified_base (281)..(281): a, c, t, g, unknown or other
  modified_base (309)..(309): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtggttttctgtgcttatttagaagtgtcagtgtgaggtgcagctggtggagtcgtgggggagtcttggtccaggtccggtgggggtccctgagctctctgtncagtcctgtggtacttcctactttagntactagttggatgacgcgtggggtcccncgagggcctacggagggggaggggtcgtagggggtaggttggggtacgaccaaagagtaaaggcgtaaaggttaggaagttagaaagtaaatacgtaaagtgtggtacttcgagggtaggaacgggtcctagttaccacctactcgtacgacgaaacgaccgaaaccgaccaaacgaacttccagttagttaactcgtaaggaactaaaagagaacacgtaccgagacgacgtcggaacgacggacggtctaagttcttaggtcttgaggtagagttgggttacggtgggggtaacgtaaggttagaggttacgggtcgttcgtaacc

SEQ ID NO: 393260 - DNA, 707 bp, Homo sapiens
  misc_feature: GZ8MTXP02HJ18B.13.79.H02.1.454.CMB.2.raw
  modified_base (264)..(264): a, c, t, g, unknown or other
tcagtcacgtactacacgaccggtgctcgatttagtgtcacacgaagggaaaggggtctcagagaggagccttagccctggactccaaggcctttccacttggtgatcagcactgagcacagaggactcaccatggaattggggctgagcgtggtttccgtgttagctattttagaaggtgtccagtgtgaggtgcagctggtggagtctgggggaggcttggtccagcctggggggtccctgagactctcctgtgcagccctntggattcactttagtagctattggatgagcgtgggtcccgccgaggcctaccggaaggggaaggggtcgtgggaggtggggtcggaccaaacgaaagtaaaaggcgtaaaggttagggaaagtaggaaagtaaaacttacgtaagttgggtcggacttcgtagtaggaacggggaccggtacgttactacctactacctaccgacgaacgaaccgaaaccgaacccgaaacgaaacctaacctaaccttacgttaacttacgttacgtaactaaaacgtaacgaaacgaacgaccgtacgaacggaacggaccggaacggaaccgaaccggtacgtacgttacgttacgtttaacgttacggttacggtacggacggtaaggtaagggttaagggggtacggggtaaacgggtaacggtaaggtacggtacggtacggtacgg

SEQ ID NO: 393261 - DNA, 542 bp, Homo sapiens
  misc_feature: GZ8MTXP02GW2R1.13.79.H02.1.454.CMB.2.raw
  modified_base (307)..(307): a, c, t, g, unknown or other
  modified_base (369)..(369): a, c, t, g, unknown or other
  modified_base (373)..(374): a, c, t, g, unknown or other
  modified_base (437)..(437): a, c, t, g, unknown or other
  modified_base (447)..(447): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcaccgtcagtcacacctacatgagctgggtcccnccaggctccgaggggaaggggctggatgcgtctcttttattatagtagtggtagtacatacnccgnngactcgtgaggggccattcaccatctccagagacaattcccaaagaacacgtctgttacttanaaatgaaacngacctgagagccgatcgacgacggcctgtattactgtgcgagagacgtcggggccctaaggaacgttacaacgctagtcggaccgtcgtacgggg

SEQ ID NO: 393262 - DNA, 434 bp, Homo sapiens
  misc_feature: GZ8MTXP02IWQUX.13.79.H02.1.454.CMB.2.raw
  modified_base (428)..(434): a, c, t, g, unknown or other
tcagtcacgtactacacgaccggtgctcgatttagtgtcacacgaagggaaagggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagcagtggcacgtactacttgactactggggccagggaaccctggtcaccgtctcctcagcctccaccagggcccatcggtcttcccctggcaccctcctccaagagcacctctcggggcacagcggccctgggctgcctggtcaaggactacttcctagtacgtgactgagcgggctggcaaggcgcatagnnnnnnn

SEQ ID NO: 393263 - DNA, 436 bp, Homo sapiens
  misc_feature: GZ8MTXP02JOFOI.13.79.H02.1.454.CMB.2.raw
  modified_base (210)..(210): a, c, t, g, unknown or other
  modified_base (345)..(345): a, c, t, g, unknown or other
  modified_base (431)..(436): a, c, t, g, unknown or other
tcagtcacgtactacacgaccggtgctcgatttagtgtcacacgaagggaaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattacngtgcgagagattggggcgaaggtatagcagtggcacgtactactttgactactggggccagggaaccctggtcaccgtctcctcagcctccaccaagggcccatcggtcttccccctggcacccctcctccaagngcacctctcggggcacagcggccctgggctgcctggtcaaggctacttcctagtacgtgactgagcgggctggcaaggcgcatagnnnnnn

SEQ ID NO: 393264 - DNA, 552 bp, Homo sapiens
  misc_feature: GZ8MTXP02FVSUQ.13.79.H02.1.454.CMB.2.raw
  modified_base (306)..(306): a, c, t, g, unknown or other
  modified_base (374)..(374): a, c, t, g, unknown or other
  modified_base (424)..(424): a, c, t, g, unknown or other
  modified_base (541)..(541): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctcgtgggttcaccgtcagtcacacctacatgagctgggccncaggctccgaggggaggggctgggagtgcgtcttcttttattatagtagtggtagtacatactccganagcctccgtggagggggccattcaccatcaccagagacaattcccgaaanaccacgcttgtttactcaaaatgaaacagcctgaagagccgatgacacggcctgtacttactgtgcgagagacgtcgggggacccaagtaacgtaactacggctagtcggacgtcgnggggtaacccg

SEQ ID NO: 393265 - DNA, 555 bp, Homo sapiens
  misc_feature: GZ8MTXP02FU6B6.13.79.H02.1.454.CMB.2.raw
  modified_base (363)..(363): a, c, t, g, unknown or other
  modified_base (373)..(373): a, c, t, g, unknown or other
  modified_base (474)..(474): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctggggttttccttgttgctattttaaaaggtgcccagtgtgaggtgcagctggtggagtctgggaggaggcttgatccagccgtgggggtccctgagactctcctgtgcagcctctgggtcacgtcagtcacacctacatgagctgggtcccgccgaggctccgaggggaacggggctggagtgcgttctctttattatagtagtgtagtanatactccgcngactccgtgacggggccgtattcacctatcctccagagacaattacccaagaacacgctagtttctaacgaaatgaaactagcctaggatacgcgatgacncggccgtgtacttactgtgcgagagacgtcggggacccacgtaaacggttacacggtctagtcggaccgtggtaccggggg

SEQ ID NO: 393266 - DNA, 584 bp, Homo sapiens
  misc_feature: GZ8MTXP02J2GD3.13.79.H02.1.454.CMB.2.raw
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagagctattggatgagctggtccgccaggctccgaggggaaggggctgggagtgggtgccaaacataaaagcaaagttggaaagtgagaaaatctaatgtggactctgtgaaacggggccaattcaaccatctccaagagaacaaacgccaaagtaaactcaactgtaatctgacaaaatagaacagacagagacgacgacggaacgaacggcgtacgtacgtaacttaacgtacgtacggacgaacggaaggaaggttaagggggtacggggaaacgggtaacgtaaggacgaacggtacggtacg

SEQ ID NO: 393267 - DNA, 640 bp, Homo sapiens
  misc_feature: GZ8MTXP02GEIC1.13.79.H02.1.454.CMB.2.raw
  modified_base (304)..(304): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctatggatgagctgggtccncaggctccgaggggagggctgggagtgggtgccaacataaagcaaggttggaagtgaagaaatactagtgtggactctggtagaacggggccgtaagttccaacccgattccctacccgaaaggacgaaccaaaccggcccaaaaggaacctcaaccgtgttaaactccgttaggaacctaaaagtcggaaaacagaccccgtaggaacggagaccccgggaagggtaacccgacggggtccttaggttaccttaagtttacgtggtaccggacgaaaggaggttaagggttcgggggacggtaaaaggttacaggaccgtaaggggttcgaaccg

SEQ ID NO: 393268 - DNA, 701 bp, Homo sapiens
  misc_feature: GZ8MTXP02GUNM6.13.79.H02.1.454.CMB.2.raw
  modified_base (304)..(304): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattgggctgagctgggttttccttgttgctatttagaaggtgtccagtgtgaggtgcagctggtggagtcgtgggggagcttggtccagccgtgggggtccctgagactctcctgtgcagcctctggattcacctttagtagctattggatgagcgtcgggtcccnccgaggcctacccggaaggggaaggggcgtggggacggtggggtcggaccaaacaagtaaagcgtaaaggttgggaaagtggaagtaaattacgtagttgtcgggacttcgtggtaggaacggggtccgtatttcccgaacctatacccgtaccaaaggaacgaacccgaaaccgacccgaaaagtaacctacaaccgtagttatcctagacctaaaagtagaaaccgtagaccccgtagggaacgacggacccggtaaaggaaccgtaccggtactttacggtaccttaaacgtttaccgtggttacggaccggtaaaggacggttaaggggttaaccggggggaaacggtaaaacgggttagtaacggaccggtaacggttaccggggtaaaccg

SEQ ID NO: 393269 - DNA, 610 bp, Homo sapiens
  misc_feature: GZ8MTXP02FRPEV.13.79.H02.1.454.CMB.2.raw
  modified_base (304)..(304): a, c, t, g, unknown or other
  modified_base (338)..(338): a, c, t, g, unknown or other
  modified_base (365)..(365): a, c, t, g, unknown or other
  modified_base (401)..(401): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggagcttggtccagccgtggggggtccctggagactctcctgtgcagcctctggattcacctttagagctattggatgagctggtccnccaggctcgagggagggctggagtgggtgccaanataaagcaagttggaagtgagaaactntatgtggactcgtgtgaaggggccattcaaaccctntcctacgagaacgaacaacgaccaaagtaactcactgtatcgagaactaaagtacgaaacgacgccgtaggaacgacggaccggaaggaccgtacgggtacttacgtacttaacgtttacgtggtacggtacggtaacggtaaggtaacgggtaacgggggtaacggggtaaacgggtaacggtaacggtacggtacggtacggtaacg

SEQ ID NO: 393270 - DNA, 686 bp, Homo sapiens
  misc_feature: GZ8MTXP02JXBVC.13.79.H02.1.454.CMB.2.raw
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtgggttttccttgttgctatttagaaggtgtccagtgtgaggtgcagcgtgggtggaggtcggtgggggaggtcgttggtccgaggtcccggttcggggggtccctggacgtactccgtccgtgtgcagtcctgtggtcttccgtacctttagtagtcttaagttggatggagtcgtcgggtccgcaggctccggaaggggacgggcgtgggaggtggggtcgaccaaactaaagtaaagacgaaaggttacggaagtagaaagtaaaatctaagttcgggtgtactcggttaggtagggaacgggggtacctaacgtttccaaccctacttcccgtaacccgaagaaccgaaaccgaacgaacccaaagtaacctactacgtagtactactagaactaaagtacaaacgacgtccgtaggaagaccggacccgaaggtaccgacgtcgtcgttactactttacgaggttcgacgtaaggacggttagggggttcgggaaggggtaagtaggtagtccgaggtacggtaaaccg

SEQ ID NO: 393271 - DNA, 665 bp, Homo sapiens
  misc_feature: GZ8MTXP02IUGUV.13.79.H02.1.454.CMB.2.raw
  modified_base (278)..(278): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcgtgggttttccttgttgctattttagaaggtgccagtgtgaggtgcagctggtggagtctggaggaggcttgatccagccgtgggggtccctgagtactctcctgtgcagcctcgtggtccaccgtnacgtcacacctacatgacgcgtcgggtaccgccgaggcctacccgaggggaaggggcttgggagtcgcgttctttcttttattatagtagtggtatacatactccgctagactccggtgacggggcattccactatccgtaccagacgactaaacgttaccgaaaagaaccctaccggtactttacgtttttaccttaacctaaaagtacggtaaacacggtcccttaaggaacgacggacccgaagtacggaacgaccgggtaccgtagttaacgttaacgttaggtcgacggaaggtacggtaacggtcgggggaacccccgtaacgggttaacccggtttaaccgtaaaccggtcttacggtacgggttaaccgttaccggggg

SEQ ID NO: 393272 - DNA, 781 bp, Homo sapiens
  misc_feature: GZ8MTXP02H8XIP.13.79.H02.1.454.CMB.2.raw
tcagtcacgtactacacgaccggtgctcgatttagtgtcacacgaagggaaaggggtcgtcagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggaggcgttggtccagccgtgggggtccctgagactctctgtgcagcctcgtggtccaccgtcagtccacacctacatgagtcgtcgggtcccgccgaacgggcctaccggaagggggaaggggccgtaggggagtcggtacgtttcttactttttaagttttagtaggttaggttaggggttaaacgtaaccgtaacttaccgtccggacgtaacggtacccgttccgggtagggaacggggggtccctaactttccgaaaccctatacccttacccgaaaggaactaaaccctaaacttacccgaaaagtaaaccaccggttacctttacggttttaccttaaaaccgtaaaaattacggaaaaccacggtacccgttagggaaacggtaaccggcccgaaagttaccggaacccggtacccggggtccgtttagggttaaactttaccggttgggtacggaccggtaaggaacggtacggtacccgggggacccctaaaacgggtaaaccgtttaaccgtacgaccgtaggtaccggtaaccggtcggtaccgggggaaacccg

SEQ ID NO: 393273 - DNA, 630 bp, Homo sapiens
  misc_feature: GZ8MTXP02I227B.13.79.H02.1.454.CMB.2.raw
  modified_base (352)..(352): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgcaggctccgaggggagggctgggagtgggtgaccaaacagtaaacgngaaaggttggaaagtgaagaaattactagttgtgggtactcgtgtaggaacgggccgtattccgaaccctattcctaccgaagacgaaccaaacggcccaaaagtaaccctctaacgtgttaaatcccgttagaacctaaaagtcgaaactaacgccctaaggaacgacggacccggaggaaccacgggtcttacggtaccttaagttacgtggtcgacggaaggtagttagggttcgggggaacggtaaaggttacgaggacgtaggtcggtaaccg

SEQ ID NO: 393274 - DNA, 626 bp, Homo sapiens
  misc_feature: GZ8MTXP02HOW0N.13.79.H02.1.454.CMB.2.raw
  modified_base (531)..(531): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagcttggtccagccggtgggggtccctggacgtactctctggtgcacgcctcgtggtacttctactttagagtcttatggatggagcgtcgggtccgccgaggcctaccggaaggggaagggcgtggggaggtggggtacggaccaaagaagtaaagctaaaggtacggaaagtaggaaagtaaatacgttagtagggtcgtaacttcgtaggtacggaacggggtcctattcccaaccgtatcccgacgaagacgaccaaacggccaaaagtacctcacgttgtaactctagaaacaaaagtcgaaaacncgactagacgacgccgaagtacgacggtctacgtaccttataccgtgacggactaggagtagggtcggggaacgtaaggtcagcgtaggtcgaac

SEQ ID NO: 393275 - DNA, 597 bp, Homo sapiens
  misc_feature: GZ8MTXP02HH1FX.13.79.H02.1.454.CMB.2.raw
  modified_base (533)..(533): a, c, t, g, unknown or other
  modified_base (560)..(560): a, c, t, g, unknown or other
  modified_base (584)..(584): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctggagactctcctgtgcagcctctggattcacctttagtagcttattggattgagtctggggtccgccgagggcctccgaggggaaggggcgtggggaggtggggtggaccaaacgaagtaaaaggctaaaggttcggaaagtgaaagtaaaatacgtaagtggtggacttcgtggtagaaacgggccgattcccaacctatcctaccaaggacgaaccaacggccaaaagtaacctcaactgtaatctagactaaaagtcgaaacagcctagagacggccgtaaggacncggctgtactattacgtgcgacgaggngtaggttgggggacgtaaaggttnaggcgaggtcgac

SEQ ID NO: 393276 - DNA, 684 bp, Homo sapiens
  misc_feature: GZ8MTXP02HEEKO.13.79.H02.1.454.CMB.2.raw
  modified_base (272)..(272): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccaggccgtggggggtccctgagactctcctgtgcagcctctggnttcaccttgatgattatgccatgcacgtcgggtccggacaagcctccgaggggacgggccgtgggagtggggtctcgtaggtagttaggttaggaataggtaggtagcgtaagtagggcgtagtcggacggtactcgtggtagggaacggggcccgtattcccaaccgctcctacccgagacgaaaccgaaccgaccgaaacgaacctacaaccttagtactccgtagaactaaaagtacggaaactacggaccgtagggaacgacgggacccgggaaaacggtacccggaaccggggttctttacggttaaacttaacgtttaccggtaggttacggaccggtaaggggtaacgggttacggggtttacgggggggaaacggttaaacggggttaacgtacgggaacgggg

SEQ ID NO: 393277 - DNA, 596 bp, Homo sapiens
  misc_feature: GZ8MTXP02F54MD.13.79.H02.1.454.CMB.2.raw
  modified_base (309)..(309): a, c, t, g, unknown or other
  modified_base (413)..(413): a, c, t, g, unknown or other
  modified_base (529)..(529): a, c, t, g, unknown or other
  modified_base (575)..(575): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcgttggtccaggccgtggggggtccctgagactctcctgtcgcacgcctctggattccacctttagagctattggatgagctgggccncaggcctaccgagggagggctggaggtgggtgccaaacagtaaagcgaagttggaagtgaaagaaatactatgtggactcgtgtagaacggggccattccaccntcctccgaagacaacaacgaccaaagaactcactgtactacgtacgaacaaagtacgaaacagacccgtagaaggacgaccggaggtaccacggtctggttaccttaatttaccgngttacgacgacggagttacggttaagggggaacggtaaagggttanacggcgacggttagggaaccg

SEQ ID NO: 393278 - DNA, 728 bp, Homo sapiens
  misc_feature: GZ8MTXP02FSFMQ.13.79.H02.1.454.CMB.2.raw
  modified_base (196)..(196): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtncagcgtggtggagtcgtgggggagtcttggtccaggccgtggggggtccctggacgtactctcctgtgcacgcctcgtggtattctaaccgtttagagtcttaagttggatggagtccgtcggggtccccgaccgagggtcccgtaccggaagggggaacggggtcgttaggggacggttggggtcggacccaaaacgtaaagtaaaacggacgtaaaggttagggaaagtagaaagtaaaatactagtggttacggaccttgtagggtacgaaacgggggtcctaactttaccaacccgtattacccgtacccgaaaggtaacgaaacccgaaacccggacccaaaagtaaacccttcaaacgttagtaactaccgttagaaccttaaagacgaaactacgacctaggaacggcgacccggaagacccgtacgggtacttacggttacttaaacgttacgtggttaggaccggtaaggaggtagggtaacgggggacggtaaaaggtacgaggtaacgcggtacgtaaccg

SEQ ID NO: 393279 - DNA, 653 bp, Homo sapiens
  misc_feature: GZ8MTXP02FWENQ.13.79.H02.1.454.CMB.2.raw
  modified_base (293)..(293): a, c, t, g, unknown or other
  modified_base (316)..(316): a, c, t, g, unknown or other
  modified_base (319)..(319): a, c, t, g, unknown or other
  modified_base (336)..(337): a, c, t, g, unknown or other
  modified_base (430)..(430): a, c, t, g, unknown or other
  modified_base (439)..(439): a, c, t, g, unknown or other
  modified_base (450)..(450): a, c, t, g, unknown or other
tcagtcacgtactacacgaccggtgctcgatttagtgtcacacgaagggaaagggggtctcagagaggagccttagccctggactccaaggcctttccacttggtgatcagcactgagcacagaggactcaccatggaattggggctgagcttgggttttccttgttgcttattttagaaggtgtccagtgtggaggtgcagctggtggagtcggtgggggagcttgggtccaggccggtggggggtccctgacgactctcctgtgcacgcctctggtattcctactttagtnctatggatggagccgtgggtccncgnggcctcgaggggagggnngggaggtggggcgacaaacgataaagcgtaaggttaggaagtgaaagtaaatcgtattgtgactagtgtaggacggcgtatcacatcacaganaaccgaacnccaaagaaccncaaagtctaactcgtacgaactaaaagtacaaacgacgtacccgaggaacggaccggtaccggaaggaaccggtccgggtaacctttgggttacttaacggtttaaaccgtggggtacgttaccgggaaaggttacgggtaacgggttaaggggggaaccggtaaaggggttactaaggggactttaggggtactaaacccgg

SEQ ID NO: 393280 - DNA, 701 bp, Homo sapiens
  misc_feature: GZ8MTXP02INDZU.13.79.H02.1.454.CMB.2.raw
  modified_base (269)..(269): a, c, t, g, unknown or other
  modified_base (287)..(287): a, c, t, g, unknown or other
  modified_base (563)..(563): a, c, t, g, unknown or other
tcagtcacgtactacacgaccggtgctcgatttagtgtcacacgaagggaaagggggtctcagagaggagccttagccctggactccaaggccttttccacttggtgatcagcactgagcacagaggactcaccatggaattggggctgagctgggttttccttgttgctattttagaaggtgtccagtgtgaggtgcagctgggtggagtcgtgggggagcttggtccagccggtggggggtccctgacgactctcctgtgcagcctntgattcacttgatgatangccatcgcacgtgggccggacagctaccgaggggaacggcgtgggagtcgggtctcgtagtattagagtaggaattaggtacggtagctaagtacggggtctaagtcggtacgtaccgttgtagggttacgggaacgggtcctacgttaccacccgtacttccgtacccaaggaacgaaccgtaaacccgacccgaaaggtaaaccccttaccccgttagtaaactttccgaagtaacccaaaaagtcgaaaccacggtacctaaggacgaacggngtacggaacgggacctacccggggttactttagggttaaactttacgttaaggtacgtaaaacgtaaaaacacccgttaaaacccccgtttaacccggttaaaacgttttacggtttttacggaaggttttaacccgg

SEQ ID NO: 393281 - DNA, 586 bp, Homo sapiens
  misc_feature: GZ8MTXP01ER4YR.39.74.G08.1.454.CMB.2.raw
  modified_base (316)..(316): a, c, t, g, unknown or other
  modified_base (323)..(323): a, c, t, g, unknown or other
  modified_base (358)..(358): a, c, t, g, unknown or other
tcagtcgcactagtcacgaccggtgctcgatttagtagctctatcagggtctctgagactctcttgtgcagcctctggattcacctttaggagttatggcatgaactgggtccgccaggctccaaggaaggggctggagtgggtctcaagttatttatgatgttagtagtagtggagactacgcaacagactacgcagacaccgtgaagggccggttcaccatctccagagacaattccaaagaacatggtgtatctaggaaatgtccagcctgagagtcgaagacacggtccgtttaattattggtgacgaaagntcggganatgatatatgctataccggtattctttgatttcgnggggacctggccacccgtggtccaccgtctcctcacgccctccaccgacgggcccacgtccggttcccttcccccgtcggccctaccccgtccctaacaacgacgccgaccgtcgtcgggggaccacgacggccgcccgtcgggctcgccgtcggtcaacgggtacttaccttccttacgtagtcgccgcgttcggaacggcgggcgtgggccgaacggccgcgtaag

SEQ ID NO: 393282 - DNA, 610 bp, Homo sapiens
  misc_feature: GZ8MTXP02HN3BT.39.74.G08.1.454.CMB.2.raw
  modified_base (219)..(219): a, c, t, g, unknown or other
  modified_base (224)..(224): a, c, t, g, unknown or other
  modified_base (244)..(244): a, c, t, g, unknown or other
tcagtcgcactagtcacgaccggtgctcgatttagtagctctatcagggtctctgagactctcttgtgcagcctctggattcacctttaggagttatggcatgaactgggtccgccaggctccaaggaaggggctggagtgggtctcaagtatttatgatgttagtagtagtggagactacgcaacagactacgcagacacgtgaaggccgtcacatcncaganacaattccaagaacatggtntatctggaaatgtccagcctgagagtcgaaagacacggtccgttttaattattggtgacgaaaagagtcggggagatgatatatgactagtaccgggatttcgtttgtatttcgtggggccgttggcctacccgtggtccacccgttctcctcacgccctccaccgaacgggcccagtcccggtcccttcccccgtggcccctaccctccctacccgaaagacgcctaaccgtccggtcgggggaccacgacgccggcccgtggggtcctacgcccgttagggtaccgaaacgggtaccttaaccgttcccgaaccttaggccgcgaaccgtgaacgggcggaccgtgggacgaacggccgtacag

SEQ ID NO: 393283 - DNA, 569 bp, Homo sapiens
  misc_feature: GZ8MTXP02GDA24.39.74.G08.1.454.CMB.2.raw
  modified_base (319)..(319): a, c, t, g, unknown or other
  modified_base (444)..(444): a, c, t, g, unknown or other
  modified_base (451)..(451): a, c, t, g, unknown or other
tcagtcgcactagtcacgaccggtgctcgatttagtagctctatcagggtctctgagactctcttgtgcagcctctggattcacctttaggagttatggcatgaactgggtccgccaggctccaaggaaggggctggagtgggtctcaagtatttatgatgttagtagtagtggagactacgcaacagactacgcagacaccgtgaagggccgttcaccatctccagagacaattccaaagaacatggtgtatctaggaaatgtccagcctgagagtcgaagacacggccgttttatattgtgacgaaagagtcggganatgatatatcgatacgtaccgggtatttcgtttgtatttcgtgggggcctgggccaccccgtggtccaccgtctccgtcacgccctccaacccgacgggcccatcggtcctcccccgtggacccnccctccnccaaagagccacgtcgtggggaccacgacgccggcccgtgggcttcggccgtaggtacaacggtactactttccaacttcgtcgcgacgtgaacggcggtcgcggacgacggcactag

SEQ ID NO: 393284 - DNA, 639 bp, Homo sapiens
  misc_feature: GZ8MTXP02J0VUU.39.74.G08.1.454.CMB.2.raw
  modified_base (520)..(520): a, c, t, g, unknown or other
  modified_base (576)..(576): a, c, t, g, unknown or other
tcagtcgcactagtcacgaccggtgctcgatttagtagctctatcaggggtctgagagaggagcccagccctgggattttcaggtgttttcatttggtgatcaggactgaacagagagaactcaccatggagtttgggctgagttggcttcttcttgtgactagttttaaaaggtgtccagtgtgaggtgcagctggtggagtcgtgggggagccgtggtcaaggccgtgggggtccctgagactctcctgtgcagcctctggtattccaccttcagtagctatagacatacgaacgtcgggtcccgccgaggccgtaccggaaggggaaggggtcgtaggggaggttcgggtcctacgactaccgtagttaggtacgttagtagtagttaacattataactacgcaacgtactacgagtagaacggggcctattacccgaacctattcccgaacgaagacgaacaaaccgaccaaaacgactcctagtagttactcgacaaactaaataccggaaaccncgtaccgtaaggacggaccggaccggacgtaacgcggtacgtagtagtacgttcgnggtacgtacggtttaggttttcggttttggttagcgttacgtacgttacgtacgacggtacgg

SEQ ID NO: 393285 - DNA, 511 bp, Homo sapiens
  misc_feature: GZ8MTXP01BW6J7.11.60.F05.1.454.CMB.2.raw
  modified_base (314)..(314): a, c, t, g, unknown or other
  modified_base (396)..(396): a, c, t, g, unknown or other
  modified_base (442)..(442): a, c, t, g, unknown or other
tcagcgagagataccacgaccggtgctcgatttagtacgtcatcagggaaaggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaagagccaccctctcctgcagggccagtcagagtattagcagcaacttagcctggtaccaacaaaacctggccaggctcccaggctcctcttctatggtgcatccaacaggggccnctggtatcccagccaggttcagtggcaggtgggtctgcgacagagttcactctcaccatcagcagtctgcagtctgaaagtnttttgctagtttatactgtcaggtcagtataatgactggccctccngtggacgttcggcaagggccaagggtggaaatcgaaagacgttgttggctgccacgattctgttcttcg

SEQ ID NO: 393286 - DNA, 555 bp, Homo sapiens
  misc_feature: GZ8MTXP01D1GO5.11.60.F05.1.454.CMB.2.raw
  modified_base (200)..(200): a, c, t, g, unknown or other
  modified_base (300)..(300): a, c, t, g, unknown or other
  modified_base (315)..(315): a, c, t, g, unknown or other
  modified_base (401)..(401): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaangccaccctctcctgcagggccagtcagagtattagcagcaacttagccctaggtaccaacaaaacctggaccaggctcccaggcctcctcttctatggtncatccaacagggccnctggtactcccagccaggttcagtggcaggtgggtctgcgacaagagttcactctcaccatcagcagtctgcagtctagaaagttntttgacttagtttattctgtacaggtactaagttataagtcgtacgtcggtccctaccgtaggtcggtaccgttcggaccgaaagggaccgaaagggtacgaaacgtacgaaacgttacgttggttacggctgaaccactattcttcgttcttc

SEQ ID NO: 393287 - DNA, 567 bp, Homo sapiens
  misc_feature: GZ8MTXP01DY9M7.11.60.F05.1.454.CMB.2.raw
  modified_base (201)..(201): a, c, t, g, unknown or other
  modified_base (301)..(301): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaangcccacctctcctgcagggccagtcagagtattagcagcaacttagcctaggtaaccaaacaaaacctggaccaggctccaggtctcctcttctatggtncatcccaagacgggccgctggtactcccagcctaggttcaggtggctaggtcgggtctgcgacagtagttcactctacaccatcagcagtctgcagtctagtaagttattttgctagtttatacgtgtacaggtctagttaataagtgacgtcggccctacccgaggttcggtacgttcggccgaaaggggaccaaagggttggaaacgtaccgaaaagttaacgttggacgggtctacgcctacctattcgttcgttctttaacc

SEQ ID NO: 393288 - DNA, 555 bp, Homo sapiens
  misc_feature: GZ8MTXP01C8OO8.11.60.F05.1.454.CMB.2.raw
  modified_base (201)..(201): a, c, t, g, unknown or other
  modified_base (307)..(307): a, c, t, g, unknown or other
  modified_base (313)..(313): a, c, t, g, unknown or other
  modified_base (398)..(398): a, c, t, g, unknown or other
tcagcgagagataccacgaccggtgctcgatttagtacgtcatcagggaaagggggaggaactgctcagttaggacccagacggaaccatggaagcccagcgcagcttctcttcctcctgctactctggctcccagataccactggagaaattgtgatgacgcagtctccagccaccctgtctgtgtctccgaggggaaangccaccctctcctgcagggccagtcagagtattagcagcaacttagcctaggtaccaacaaaacctggaccaggctccaggctcctcttctatggtgcatccaacngggccntggtatcccagccaggttcagtggcaggtgggtctgcgacaagcgttcactctcaccatcagcagtctgcagtctagaaagtttntttgacttagtttatactgtacaggtctaagttaatagtcgcgtcggccctaccgaggtcggtaccggtcgggaccggtaaagggacgaaagggtacgaaacgtacgtaaacggttacgttggttacgctacgaacctacgtattcttcgttcttcg

SEQ ID NO: 393289 - DNA, 546 bp, Homo sapiens
  misc_feature: GZ8MTXP01CB9X8.11.60.F05.1.454.CMB.2.raw
  modified_base (203)..(203): a, c, t, g, unknown or other
  modified_base (317)..(317): a, c, t, g, unknown or other
  modified_base (418)..(418): a, c, t, g, unknown or other
  modified_base (526)..(526): a, c, t, g, unknown or other
  modified_base (528)..(528): a, c, t, g, unknown or other
  modified_base (536)..(536): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagcccaccctgtctgtgtctccgaggggaaangcccaccctctcctgcagggccagtcagagtatagcagcaacttgcctaggtaccaacaaaacctggccaggcctcccaggcctcctcttctatggtgcatccaacgagggccnctggtactccccagcctaggttcaggtggcaggtcggggtctggccgacgaagtacgtttcactcctcaccatcagctagtctgcagttctaggtaagttnttttgcttaagtttacttacgtgtacaggggtctaaggttactaagtcgacgtcggaccttccgacgtggaccgtcggacaagggcaggtacgaatacgaagagttgngntgaacacnttctgttctc

SEQ ID NO: 393290 - DNA, 572 bp, Homo sapiens
  misc_feature: GZ8MTXP01BZTLF.11.60.F05.1.454.CMB.2.raw
  modified_base (411)..(411): a, c, t, g, unknown or other
  modified_base (422)..(422): a, c, t, g, unknown or other
  modified_base (473)..(473): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactgaggggggaaattgtgatgacgcagtctccagccaccctgtctgtgtctccgaggggaaagagccaccctctcctgcagggccagtcagagtattagcagcaacttagcctaggtaaccaaacaaaacctggccaggcctcccaggctcctcttctatggtgcatcccgaacgacggggccgcgtggtactccccgagcccgaggttcaggtggcaggtgggtctggcgacaagacgttcactcctacaccatcagcagtctggcngtcagtaagtnttttgctagtttattactgtcaggtctaagtataatgacgtggccctccgngtggaccgttcgaaccggaacgggacaagggtgaaacgtaccgaaaaggttaccgttgggttacggctggcctaacccgtgttcctcgttccttaaccg

SEQ ID NO: 393291 - DNA, 630 bp, Homo sapiens
  misc_feature: GZ8MTXP01AV96Y.11.60.F05.1.454.CMB.2.raw
  modified_base (202)..(202): a, c, t, g, unknown or other
  modified_base (299)..(299): a, c, t, g, unknown or other
  modified_base (315)..(315): a, c, t, g, unknown or other
  modified_base (401)..(401): a, c, t, g, unknown or other
  modified_base (421)..(421): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaangcccaccctctcctgcagggccagtcagagtattagcagctaacttagcctaggtaaccaaacaaaacctggccaggctccagctcctctctatgtncatccaacgagggccnctggtactcccagccgtaggttcagtcggctaggtgggtctggcgacgaagtacgtttccactctaccacctatccagccagttcngactagtctaggtaaagttnttttagacgtttaagtttacttacgtgttacgtaggtacgttaagttaataacgtgtaccgtccggtacccttacccggtacggttccgggtaccggttccggaaccggtaaacgggtaacgttaaaggggtaacgaaactaaaccgtaaaacggttacgttggttacgctacgaaccctactacgttctttaacgtttccgtttaacg

SEQ ID NO: 393292 - DNA, 570 bp, Homo sapiens
  misc_feature: GZ8MTXP01DBUFL.11.60.F05.1.454.CMB.2.raw
  modified_base (201)..(201): a, c, t, g, unknown or other
  modified_base (320)..(320): a, c, t, g, unknown or other
  modified_base (556)..(556): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaangccaccctctcctgcagggccagtcagagtattagcagcaacttagccctaggtaaccaacaaaacctggaccaggctccgaggctcctcttctatggtgcactccaacgacggggccnctggtactcccgagccgtaggttcagtggctaggtgggtctggcgacgagagttcactcctaccacatcagctagtctgcagtctagaaagttcttttgacttagtttattactgtcaggactagttaataagtgtacgtcggtccctacccgtggtcggtaccgttcgggaccgtaaagggaccgaaggggtacgaaagtccgaaaacgttacgttggttacggctagccacctnttcgttcgttcttc

SEQ ID NO: 393293 - DNA, 503 bp, Homo sapiens
  misc_feature: GZ8MTXP01DB606.11.60.F05.1.454.CMB.2.raw
  modified_base (201)..(201): a, c, t, g, unknown or other
  modified_base (445)..(445): a, c, t, g, unknown or other
  modified_base (486)..(486): a, c, t, g, unknown or other
  modified_base (493)..(493): a, c, t, g, unknown or other
  modified_base (503)..(503): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaangccacctctcctgcagggccagtcagagtatagcagcaacttagccctaggtaccaacaaaacctggaccaggctcccaggctcctcttctatggtgcatccaacgcgggccgctggtactcccagcctaggttcagtggctagtgggtctgcgacaagagttcactctacaccatcagcagtctgcagtctagaagtattttgctagtttatactgtcaggtctagtatagtgactggcctcngtggacgtcggcaaggcaggtagaaatcgaaagacttgagntgcactnttctgttctn

SEQ ID NO: 393294 - DNA, 577 bp, Homo sapiens
  misc_feature: GZ8MTXP01A8VFN.11.60.F05.1.454.CMB.2.raw
  modified_base (201)..(201): a, c, t, g, unknown or other
  modified_base (307)..(307): a, c, t, g, unknown or other
  modified_base (317)..(317): a, c, t, g, unknown or other
  modified_base (324)..(324): a, c, t, g, unknown or other
  modified_base (415)..(415): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccacctgtctgtgtctccgaggggaaangccaccctctcctgcagggccagtcagagtatagcagcaacttagcctaggtaaccaaacaaaaaccgtggaccaggcctccccgaggcctcctcttctagtggtncatccaacgnggggccnctcggtactcccgagcctaggttcaggtggcaggtgggtctgcgacaagtcgttcactctacaccatcagcagtctgctagtctagaagtntttgcttagtttatactgtacaggctaagtataagtgacgttcggacccttcccgaggttcggtaccgttcggaccgaaaggggaccttaaaggggacggaaactacgaaaacgttagttgggttcggaacctgaaccctacacgttctaacgttcttaacc

SEQ ID NO: 393295 - DNA, 597 bp, Homo sapiens
  misc_feature: GZ8MTXP01AYHIG.11.60.F05.1.454.CMB.2.raw
  modified_base (203)..(203): a, c, t, g, unknown or other
  modified_base (409)..(409): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagcccaccctgtctgtgtctccgaggggaaangccaccctctcctgcagggccagtcagagtattagcagcaacttagcctagtaccaacaaaactggaccaggctccgaggctcctcttctatggtgcatccaacgacgggccgctggtactcccagcctaggttcaggtggcacggtgggtctggcgacaagtacgttcactctcactatcagcagtctagctagtctagaagttnttttcgacttaagtttacttaacgtgttacagggtactaaggtactaagtcgtactcggcctacccgacggtgggaccgttccggaacgaaacggggtaccgttaaagggtagaaaacgtcgtaaaacggaacgttggttacggaacgttacgaaccgtacccgtagttccgttcgttcgtttaaccc

SEQ ID NO: 393296 - DNA, 613 bp, Homo sapiens
  misc_feature: GZ8MTXP01AO7CH.11.60.F05.1.454.CMB.2.raw
  modified_base (202)..(202): a, c, t, g, unknown or other
  modified_base (394)..(394): a, c, t, g, unknown or other
  modified_base (423)..(423): a, c, t, g, unknown or other
  modified_base (571)..(571): a, c, t, g, unknown or other
  modified_base (594)..(594): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaangccacctctcctgcagggccagtcagagtattagcagcaacttagcctaggtaaccaaacaaaaccgtggaccaggcctcccgaggcctcctcttctatggtgcatacccaacgacgggccgcgtggtactcccgagccgtaggttcaggtggcgtaggtggtctgcgacgtaagacgttcactctcacctntcagcagtctggactgtctgtaaacgttntttggacttaagtttacttacgttgttacgaggtactaaggttattaagtgaccgttcggtccctaccgtacggtcgggtaccgttcgggaccgtaaacgggaccgttaaaggggtaacgaaacgttaacgaaaacgttacgttcggngggtaacctcggtcctaaccgtnttcctgtttcccttaaccg

SEQ ID NO: 393297 - DNA, 579 bp, Homo sapiens
  misc_feature: GZ8MTXP02HSJVQ.11.60.F05.1.454.CMB.2.raw
  modified_base (394)..(394): a, c, t, g, unknown or other
tcagcgagagataccacgaccggtgctcgatttagtacgtcatcagggaaaggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaacctggccaggctcccaggctcctcttctatggtgcatccaacagggccgctggtatcccagccaggttcagtggcagtgggtctgcgacagagttcactctcaccatcagcagtctgcagtctgaaagttntttgcttagtttatctgtacagtactaagttataagtcgtacgtcggtaccctacccgacggttcggtaccggttccgggaaccgtaaacggggacccgtaaaggggtacggtaaaacgttaccgaaaacgtaacgttggtacggtaacgtacgacctaccgtatttccgtacgtttacctttac

SEQ ID NO: 393298 - DNA, 547 bp, Homo sapiens
  misc_feature: GZ8MTXP02HLH91.11.60.F05.1.454.CMB.2.raw
  modified_base (364)..(364): a, c, t, g, unknown or other
tcagcgagagataccacgaccggtgctcgatttagtacgtcatcagggaaaggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaagagccaccctctcctgcagggccagtcagagtatagcagcaacttagcctggtaacccaacaaaacctggccaggctcccaggcctcctcttctatggtgcatcccaacgacggggccgctggtactccccgagccaggttcagtggcagtggtctgcgacagngttcactctcaccatcagcagtctgcagtctagaatattttgctagtttattacgtgtctagctaagtataagtgactcggccctccgacgtggacgttcggaccgaaagggaccaaagggtaggaaaacgtacgaaaacgtactaggtagaacgtcggactaccgattactcgttactttcc

SEQ ID NO: 393299 - DNA, 598 bp, Homo sapiens
  misc_feature: GZ8MTXP02F4E4P.11.60.F05.1.454.CMB.2.raw
  modified_base (300)..(300): a, c, t, g, unknown or other
  modified_base (413)..(413): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaacctggccatgcctcccagcctcctcttctagtggtncactaccaacgacgggccgtcgtggtactcccgagccgtaggttcaggtggccgtaggtgggtctggcgacagtgtcactctcaccatcagctagtctgcagtctagaagttnttttgacttagtttattacgtgtacagtactaagttataagtcgacccggtcctccccgtacggttcgggtaccgttaccgggaccgtaaacggggacccgaaagggtaacggaaaacgttacgaaaacggtaacgtggttacgggaacttacgacctaacctagttccgtacgttcctttaccg

SEQ ID NO: 393300 - DNA, 405 bp, Homo sapiens
  misc_feature: GZ8MTXP02G3J86.11.60.F05.1.454.CMB.2.raw
  modified_base (245)..(245): a, c, t, g, unknown or other
  modified_base (348)..(348): a, c, t, g, unknown or other
  modified_base (399)..(405): a, c, t, g, unknown or other
tcagcgagagataccacgaccggtgctcgatttagtacgtcatcaggggaaagggccaccctctcctgcagggccagtcagagtattagcagcaacttagcctggtaccaacaaaacctggccaggctcccaggctcctcttctatggtgcatccaacagggccgctggtatcccagccaggttcagtggcagtgggtctgcgacagagttcactctcaccatcagcagtctgcagtctgaagtnttttgctagtttatactgtcagcagtataatgactgcctccagtggacgttcggaccaaggacaaggtgaaatcaaacgactgtgctcgcacatctgtcttcnctcttcccgcatctgatatctctcgctgagcggctggcaagggcacatagnnnnnnn

SEQ ID NO: 393301 - DNA, 567 bp, Homo sapiens
  misc_feature: GZ8MTXP02J005D.11.60.F05.1.454.CMB.2.raw
  modified_base (201)..(201): a, c, t, g, unknown or other
  modified_base (317)..(317): a, c, t, g, unknown or other
  modified_base (379)..(379): a, c, t, g, unknown or other
  modified_base (403)..(403): a, c, t, g, unknown or other
  modified_base (425)..(425): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaangccaccctctcctgcagggccagtcagagtattagcagcaacttgcctggtaaccaacaaaacctggccaggctcccaggcctcctcttctatggtgcatcccaacgaggggcccncgtggtactcccagccaggttcagtggcaggtgggtctggcgacagtagttcactctcaccntcagcagtctgcagtctagaagtnttttgcttagtttatactgtanagtctagttaatagtcgactcggtaccctacccgtacggtggtaaccgttcgggaacccgtaaaggggacccgtaaagggtacggaaaactacgaaaacgtaactgggtacgcgtcgacctaccgtatcgttacgttcttac

SEQ ID NO: 393302 - DNA, 606 bp, Homo sapiens
  misc_feature: GZ8MTXP02JF490.11.60.F05.1.454.CMB.2.raw
  modified_base (202)..(202): a, c, t, g, unknown or other
  modified_base (309)..(309): a, c, t, g, unknown or other
  modified_base (442)..(442): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaancgccaccctctcctgcagggccagtcagagtattagcagctaacttagcctaggtaaccaaacaaaacctggaccaggcctcccgaggtcctcctcttctagtggtncatccaacgacggggcccgcgtggtactccccgagcctaggttcaggtcggcacggtgggtctgacggacaggttacgttccacttcctaccaaccctataccagctaggttcctggctaagtctagaaattnttttggactttagtttacttctgtacaggtactagttaatagtgacgtcggtccctaccgacggtcggtaacggttcggaccgtaacgggaccgtaagggtacgaaaactaccgaaaacgtacgtggtacggctcggaccctactattcgtacgttactttacg

SEQ ID NO: 393303 - DNA, 556 bp, Homo sapiens
  misc_feature: GZ8MTXP02G005X.11.60.F05.1.454.CMB.2.raw
  modified_base (204)..(204): a, c, t, g, unknown or other
  modified_base (426)..(426): a, c, t, g, unknown or other
  modified_base (507)..(507): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctccagataccactggaagaaattgtgatgacgcagtctccagcccaccctgtctgtgtctccgaaggggaaanacgcccaccctctcctgcagggccagtcagagtattagcagcaacttgcctaggtaaccaaacaaaacctggccaggcctcccaggcctcctcttctatggtgcactccaaacgaggggtccgctacggtactccccgagcctagggtttcaggttgggcaggttggggtctggacgacgagtagttcactctacaccatcagcatctgctagtctagaatnttttgacttagtttattactgtcaagtctaagtataatgactcggcctccgaggtcgacgttcgacgaacggacaaggtanaaatacgaaaacgaactgtacggctacgaccaactatctcgttacttac

SEQ ID NO: 393304 - DNA, 611 bp, Homo sapiens
  misc_feature: GZ8MTXP02HDFHZ.11.60.F05.1.454.CMB.2.raw
  modified_base (202)..(202): a, c, t, g, unknown or other
  modified_base (319)..(319): a, c, t, g, unknown or other
  modified_base (360)..(360): a, c, t, g, unknown or other
  modified_base (409)..(409): a, c, t, g, unknown or other
tcagcgagagataccacgaccggtgctcgatttagtacgtcatcaggggaaagggggaggaactgctcagttaggacccagacggaaccatggaagccccagcgcagcttctcttcctcctgctactctggctcccagataccactggagaaattgtgatgacgcagtctccagccaccctgtctgtgtctcgaggggaaangccacctctcctgcagggccagtcagagtattagcagcaacttagcctaggtaacccaaacaaaacctggccaggcctccaggctcctcttctatggtgcatcccaacacgggcccntggtactcccagccaggttcagtggcaggtgggtctgcganagtagttcactctcaccatcagcagtctagctaaggtctgtaaagtttntttagactttaagtttacttacgttgtacaggtacttaaagttataagttcgtaccgttaccgacccgttaccggtacgggttccggtaccgggttccggaaaccggtaaaacggggtaaccgtaaagggtaacgtaaaactaaccgaaaacgtacgtaggtacgaacgtacgaccgtacgtattccgttacgttaccttcg

SEQ ID NO: 393305 - DNA, 572 bp, Homo sapiens
  misc_feature: GZ8MTXP02HRHEG.11.60.F05.1.454.CMB.2.raw
  modified_base (202)..(202): a, c, t, g, unknown or other
  modified_base (305)..(305): a, c, t, g, unknown or other
  modified_base (324)..(324): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaanacgccaccctctcctgcagggccagtcagagtatagcagcaacttagcctggtaaccaaacaaaacctggaccaggcctacccaggcctcctcttctatggtncatccaacgacggggcccncgtggtactcccgagcctaggttcaggtggctaggtcgggtctggacgagacgtagttccactcctacaccatcgagccagttcagtctagtctagaagttatttgacttagtttatactgtacagtctaagtactagtcgactcggcctaccgaggttcgacgtcgaccgaagggaccaaagggtactaaacgtacgaaacgtacgtgtcggaacttacgaccaccgtatccttacgtacctttacg

SEQ ID NO: 393306 - DNA, 589 bp, Homo sapiens
  misc_feature: GZ8MTXP02FLT01.11.60.F05.1.454.CMB.2.raw
  modified_base (201)..(201): a, c, t, g, unknown or other
  modified_base (301)..(301): a, c, t, g, unknown or other
  modified_base (319)..(319): a, c, t, g, unknown or other
  modified_base (411)..(411): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctcagcccaccctgtctgtgtctccaggggaaangccaccctctcctgcagggccagtcagagtattagcagcaacttgcctggtaaccaaacaaaaccgtggccaggctcccgaggcctcctcttctatggtncatccaacgaggggcccncgtggtactccccagcctaggttcaggtggcaggtggggtctggcgacgagtagttcactctcaccatcagcagtctgcagtctagaagttntttgacttagtttattacgtgtacagtactagttaataagtcgtaccgttccggtaccctacccggacggttcgggtaaccggttaccgggaaccgtaaacggggtaccgtaaagggtaaacgaaactaacgaaaacgtacgtggtacggctacgacccactacgtcgtcgtcttacg

SEQ ID NO: 393307 - DNA, 628 bp, Homo sapiens
  misc_feature: GZ8MTXP02G5AWG.11.60.F05.1.454.CMB.2.raw
  modified_base (203)..(203): a, c, t, g, unknown or other
  modified_base (322)..(322): a, c, t, g, unknown or other
tcagcgagagataccacgaccggtgctcgatttagtacgtcatcaggggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaangccaccctctcctgcagggccagtcagagtattagcagctaacttgcctaggtaaccaaacaaaacctggccaggctcccaggcctcctcttctatggtgcatccaacgacgggcccgngtcggtactccccgagccgaggttcagtggcaggtgggtctgcgacagcgttcacgtctaccaccatcgagctacgtctaggctaagttctagtaaacgttattttggacttaggtttacttacgttgtactaggctaagtaacttagtacgtacgtcggtaccctcccgtacggttcgggtaaccgtttccgggaaccgtaaacggggaaccgaaaggggttaacggaaaacgtaaccgtaaaacgaccgttaggtacggaaccgtacgaccgtaaccctagttcccgttagttcctttaacccg

SEQ ID NO: 393308 - DNA, 442 bp, Homo sapiens
  misc_feature: GZ8MTXP02JKWL5.11.60.F05.1.454.CMB.2.raw
  modified_base (245)..(245): a, c, t, g, unknown or other
  modified_base (251)..(251): a, c, t, g, unknown or other
  modified_base (281)..(281): a, c, t, g, unknown or other
  modified_base (338)..(338): a, c, t, g, unknown or other
  modified_base (359)..(359): a, c, t, g, unknown or other
  modified_base (370)..(370): a, c, t, g, unknown or other
  modified_base (426)..(426): a, c, t, g, unknown or other
  modified_base (431)..(442): a, c, t, g, unknown or other
tcagcgagagataccacgaccggtgctcgatttagtacgtcatcaggggaaagggccaccctctcctgcagggccagtcagagtattagcagcaacttagcctggtaccaacaaaacctggccaggctcccaggctcctcttctatggtgcatccaacaggggcccgctggtactcccagccaggttcaggtggcaggtgggtctgcgacagagttcactctcaccatcagcagtctgctagtcngaagtntttgctagtttatactgtcagcagtataangactggcctccagtggtacgtcggaccgaaagggccaaggtgaaatacaaacgatgnggctcgcaccatctgtcttcncttccgtcccnctatctagacgttctcttcctcgcgtggacggtccggtacgtggacgaaggccganagtgnnnnnnnnnnnn

SEQ ID NO: 393309 - DNA, 614 bp, Homo sapiens
  misc_feature: GZ8MTXP02HNAB3.11.60.F05.1.454.CMB.2.raw
  modified_base (309)..(309): a, c, t, g, unknown or other
  modified_base (440)..(440): a, c, t, g, unknown or other
  modified_base (524)..(524): a, c, t, g, unknown or other
  modified_base (570)..(570): a, c, t, g, unknown or other
tcagcgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccgaggggaaagcgccacccctctcctgcgagggccagtcagagtattagcagctaacttgcctaggtaaccaaacaaaaacctggaccaggcctccgaggcctcctcttctagtggtncactccgaacgacggggccctcgtacggtactcccagccgtaggttcgaggtggtccgagggttcggggtcctagggaccgaatacggtaacgttccgtaaccttcctaccaccctagtcagtccagttcncggtacagggtttcaggtaaattcgttttagacctttagtttaacttctggtactagcttaagtattagtcgacgtcgtacccnccgtgtcgggtacgtccggacggtaaggaccggtaagtacgtaaanacgaacgtactgacggtcagacccagtctcgttcgttacttacc

SEQ ID NO: 393310 - DNA, 771 bp, Homo sapiens
  misc_feature: GZ8MTXP02JTTFK.11.60.F05.1.454.CMB.2.raw
  modified_base (201)..(201): a, c, t, g, unknown or other
  modified_base (328)..(328): a, c, t, g, unknown or other
  modified_base (507)..(507): a, c, t, g, unknown or other
tcagcgagagataccacgaccggtgctcgatttagtacgtcatcaggggaaagggggaggaactgctcagttaggacccagacggaaccatggaagccccagcgcagcttctcttcctcctgctactctggctcccagataccactggagaaattgtgatgacgcagtctccagccacctgtctgtgtctcgaggggaaancgcccaccctctcctgcgacgggccagtcagagtatagcagactaacgttagccgttaggtaaacccaaacaaaacccgtggacccaaggcctacccgaggtccttccctactttcctagtcgggtnaccacgtaccccgaaacggacggggccccgtgtacggtacctccccgagtacccgtaggttaccaggtcggcgtagggtcgggtcctaggacgacgtagtacgtttccgaacttccctaccaacctagtaccagtaccgtaacgttcctcggacgtaacggttcgtaaaggtaacgttntttttacggaccgtttaaggtttttaaactcggtttacggtaacgtacgtaacgttaaagttaaacttaaggttcccgaaacggttcccgggaacccccgtttacggtaacgggttaccggggttacccggttaccggggaaccggtaaaacgggggtaccgtaaaggggtaacggtaaaactaacccggtaaaacggtaccggttggaccgggtaaccttcggaaacctacgttacgttaccgtttagttaccctttaaccgg

SEQ ID NO: 393311 - DNA, 339 bp, Homo sapiens
  misc_feature: GZ8MTXP01CT0A8.38.17.B06.1.454.CMB.2.raw
  modified_base (337)..(339): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttccccctggcgccctgctccaggagccacctccgagagcacagcggccctgggctgcctggtcaaggactacttccacgtgatcgactgagcgggctggcaaggcgcatagnnn

SEQ ID NO: 393312 - DNA, 340 bp, Homo sapiens
  misc_feature: GZ8MTXP01EIBPJ.38.17.B06.1.454.CMB.2.raw
  modified_base (267)..(267): a, c, t, g, unknown or other
  modified_base (336)..(340): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatccggtcttcccctggcgccctgctccaggacgcacctccgagagcacngcggccctgggctgcctggtcaaggctacttccacgtgatcgactgagcgggctggcaaggcgcatagnnnnn

SEQ ID NO: 393313 - DNA, 337 bp, Homo sapiens
  misc_feature: GZ8MTXP01AT644.38.17.B06.1.454.CMB.2.raw
  modified_base (334)..(337): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttccccctggcgccctgctccaggagcacctccgagagcacagcggccctgggctgcctggtcaaggctacttccacgtatcgactgagcgggctggcaaggcgcatagnnnn

SEQ ID NO: 393314 - DNA, 341 bp, Homo sapiens
  misc_feature: GZ8MTXP01ATUG6.38.17.B06.1.454.CMB.2.raw
  modified_base (234)..(234): a, c, t, g, unknown or other
  modified_base (258)..(258): a, c, t, g, unknown or other
  modified_base (263)..(263): a, c, t, g, unknown or other
  modified_base (318)..(318): a, c, t, g, unknown or other
  modified_base (329)..(329): a, c, t, g, unknown or other
  modified_base (334)..(341): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcacgcctccaccaagggcccatcggtctcccctgcnccctgctccaggagcacctcgagngcacnggcggccctgggctgcctggtcaaggctacttccacgtgatcgactggagcgggntggcaaggctnatagnnnnnnnn

SEQ ID NO: 393315 - DNA, 336 bp, Homo sapiens
  misc_feature: GZ8MTXP02HIYMR.38.17.B06.1.454.CMB.2.raw
  modified_base (334)..(336): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttcccctggcgccctgctccaggagcacctccgagagcacagcggccctgggctgcctggtcaaggctacttccacgtgatcgactgagcgggctggcaaggcgcatagnnn

SEQ ID NO: 393316 - DNA, 362 bp, Homo sapiens
  misc_feature: GZ8MTXP02FSZDW.38.17.B06.1.454.CMB.2.raw
  modified_base (248)..(248): a, c, t, g, unknown or other
  modified_base (273)..(273): a, c, t, g, unknown or other
  modified_base (332)..(332): a, c, t, g, unknown or other
  modified_base (334)..(334): a, c, t, g, unknown or other
  modified_base (345)..(345): a, c, t, g, unknown or other
  modified_base (356)..(356): a, c, t, g, unknown or other
  modified_base (358)..(362): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctacgtgggccagggaccctggtccaccgtctcctcacgccctccaaccgaacgggcccctagttccggttcccttccccccggnggccctccctcgcctaccgaggacnccaccgcgagcgacgacgcgccgcgtggctcgcgtgacacgtctctcgagtgacgtcgngnggcggcggcgnggacgagctanannnnn

SEQ ID NO: 393317 - DNA, 336 bp, Homo sapiens
  misc_feature: GZ8MTXP02G1HSN.38.17.B06.1.454.CMB.2.raw
  modified_base (335)..(336): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaaggcccatcggtcttcccctggcaccctcctccaagagcacctctgggggcacagcggcccctgggctgccctggtcaaggctacttccacgtgatcgactgagcgggctggcaaggcgcatagnn

SEQ ID NO: 393318 - DNA, 336 bp, Homo sapiens
  misc_feature: GZ8MTXP02G1AF8.38.17.B06.1.454.CMB.2.raw
  modified_base (333)..(336): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttcccctggcgccctgctccaggagcacctccgagagcacagcggccctgggctgcctggtcaaggctacttccacgtatcgactgagcgggctggcaaggcgcatagnnnn

SEQ ID NO: 393319 - DNA, 342 bp, Homo sapiens
  misc_feature: GZ8MTXP02HIE99.38.17.B06.1.454.CMB.2.raw
  modified_base (248)..(248): a, c, t, g, unknown or other
  modified_base (335)..(342): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaaggcccatcggtcttcccctggcgccctgctccaggancacctccgagagcacagcggccctgggctgcctggtcaaggactacttccacgtgatcgactgagcgggctggcaaggcgcatacgnnnnnnnn

SEQ ID NO: 393320 - DNA, 340 bp, Homo sapiens
  misc_feature: GZ8MTXP02IIIDI.38.17.B06.1.454.CMB.2.raw
  modified_base (235)..(235): a, c, t, g, unknown or other
  modified_base (248)..(248): a, c, t, g, unknown or other
  modified_base (335)..(340): a, c, t, g, unknown or other
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttcccctggcnccctgctcaggancacctccgagagcacagcgccctgggctgcctggtcaaggactacttccacgtgatcgactggacgcgggctggcaaggcgcatagnnnnnn

SEQ ID NO: 393321 - DNA, 580 bp, Homo sapiens
  misc_feature: GZ8MTXP01CR7AE.38.28.C06.1.454.CMB.2.raw
  modified_base (241)..(241): a, c, t, g, unknown or other
  modified_base (247)..(247): a, c, t, g, unknown or other
  modified_base (249)..(249): a, c, t, g, unknown or other
  modified_base (253)..(253): a, c, t, g, unknown or other
  modified_base (497)..(497): a, c, t, g, unknown or other
tcagtcgatcacgtcacgaccggtgctcgatttagagctcacgtattgggtttgggctgagcgtgcgtttctaggtggctattttaaaaggtgtccagtgtgaggtgcaggtgtcggagtctggggggaggcttggttcagcctgggggggtccctgagactctcctgtgcagtctctggatttaacctttagtgactatgccatgatctgggtccgccaggctccagggaagggcgtggngtggtntnaganaatagtggtagggtgatcacatatacgcagacgtcggtcggggccggtcacacacacagagacacacgagacgacacactatatactaacaaatacgaccacagcgtagagaagtacgaacgacgacggtacgtagtagttagttgtgagagagacgtaccgacgtacgaccgtacgttcgtcgttcgtttgttattcgttgtcggggtacgtaacggacgtagtacgtcgtacgtctctctcncctccaccgaacgccgcgtccgttcccgttcccgtccgttccgcccgttccgtccgtccgcgcgacgaccgtccgaacgaacg

SEQ ID NO: 393322 - DNA, 629 bp, Homo sapiens
  misc_feature: GZ8MTXP01DSPUA.38.28.C06.1.454.CMB.2.raw
  modified_base (341)..(341): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctagtggctattttaaaaggtgtccagtgtgaggtgcaggtgtcggagtctgggggaggcttgggttcaggcccggggggtcctgagactctcctgtgcagtctctggattaaccttagtgactatgccatgatctggtcgccagctccaggaagggcgtggagtgggtcgtcagnaataatggtaggggtggatcaccataaattacgcgagaacgtccgggtcgggggtccgggttcggtaccactacacccaagaacggacaactacccgaacggaggacacaaccaactaataccttaaaactaaacgtacgacaacgacgacgtacgacggacggtacggacggtaacggtaccggtaccgtagttaagttagttaggtcgacggaacggtaacgacgttacccgttaaccggtaaccgtaccgtaaccgttcggttcgttacgtttcgtttcgtttcg

SEQ ID NO: 393323 - DNA, 526 bp, Homo sapiens
  misc_feature: GZ8MTXP01BHHEN.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccagggaaangccacctctcctgcagggccagtcagagtgtttcaacggctacttagcctggtaccagcaaaacctggccaggctccaggctctcatctatggtacatccgtcagggccactggtactcccagacacggttcagtggcagtgggtctggggacagacttcactctcaccatccagcagactggaggctagaagatttgctagtgtattactgttcagcagtatactaacaagtaccgtaactacgtttggaacctaagggggaccaaagcgtaggacaaccgaaacgactgtcggctggaccacgaagttctcg

SEQ ID NO: 393324 - DNA, 562 bp, Homo sapiens
  misc_feature: GZ8MTXP01CP7LU.38.28.C06.1.454.CMB.2.raw
  modified_base (216)..(216): a, c, t, g, unknown or other
  modified_base (273)..(273): a, c, t, g, unknown or other
  modified_base (286)..(286): a, c, t, g, unknown or other
  modified_base (329)..(329): a, c, t, g, unknown or other
  modified_base (392)..(392): a, c, t, g, unknown or other
  modified_base (483)..(483): a, c, t, g, unknown or other
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctgggggggtccctgagactctcctgtgcagtctctggattaacctttagtgactatgccatgatctgggtccnccaggctccgaggggaaggggctgggagtgggtctcagcaattaatgggtaggggtnatcacatatacgnagacgtcgggtggggccgtcacatcacagacacactcgagacncacatatatacaacaatcaccacagctagagaagacgaaggacgacgggtcgtagtattgtgngacgagagacgtaccgacgtacgacgtacgttgtgtcgttgttattcgttcgtcggggacgacggacgtacgtacgtcgtcgtctctctcncctccaccgaacgccgcgtccgttcccgtcccgtccgccgccgttccgcctccgcgacgaccgaccgtccgaacgaacg

SEQ ID NO: 393325 - DNA, 534 bp, Homo sapiens
  misc_feature: GZ8MTXP01DBJK6.38.28.C06.1.454.CMB.2.raw
  modified_base (339)..(339): a, c, t, g, unknown or other
  modified_base (422)..(422): a, c, t, g, unknown or other
  modified_base (493)..(493): a, c, t, g, unknown or other
tcagtcgatcacgtcacgaccggtgctcgatttagagctcacgtattgggtttggggagctctgagagaggagcccagccctgggattttcaggcgttttcattggtgatcaggactgaacagagagaactcaccatggagtttgggctgagctggctttttcttgtggctattttaaaaggtgtccagtgtgaggtgcaggtgtcggagtctgggggaggcttggttcagcccggggggtccctgagactctcctgtgcagtctctggattaaccttagtgactatgccatgatctgggtccgccaggctccgaggggaaggggctgggagtgggtcncagcaaattatggtaggggtgattcaccataattacgcagactccggtgggggccgttcacatcacagagacaactccaaggncacactatatactaacaaatcgacacacgacctgagagtacgaggacgacggccgtgtaattattagtggngagagacgccgacgaacgacgtcgtcgtgttcttgttgttg

SEQ ID NO: 393326 - DNA, 635 bp, Homo sapiens
  misc_feature: GZ8MTXP01CO2LI.38.28.C06.1.454.CMB.2.raw
  modified_base (269)..(269): a, c, t, g, unknown or other
  modified_base (326)..(326): a, c, t, g, unknown or other
  modified_base (341)..(341): a, c, t, g, unknown or other
  modified_base (399)..(399): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtagggggtnatcacatatacgcagcgtccgggtgggggccgtcaccatcacagacacactcagacncacatatatactaanaagtcgaccacacgctagagaacgtacggaacggacgacgggtcgttagtattagtgngacgagacgtaccgtaccgaacggtacgaccttacgttggtcgttcgtttagtatttcgtggtacggggaacgtaaagggtactaaggtcgtaccgtaccgttcttcctcgtaccgtccctaccgaccggtaaccggtcccttaccggtttccccggtttccccgtcggtccccgttcccgttcgttcccgtaaccggacgggtccgtcccgacccgttaccggaacgccgaaccg

SEQ ID NO: 393327 - DNA, 589 bp, Homo sapiens
  misc_feature: GZ8MTXP01AIV9T.38.28.C06.1.454.CMB.2.raw
  modified_base (259)..(259): a, c, t, g, unknown or other
  modified_base (270)..(270): a, c, t, g, unknown or other
  modified_base (315)..(315): a, c, t, g, unknown or other
  modified_base (326)..(326): a, c, t, g, unknown or other
  modified_base (388)..(388): a, c, t, g, unknown or other
  modified_base (569)..(569): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagngggtaggggtnattcacatatacgcagactcggtgggggccgtcaccatcacaganacactcaggancacactatatctaacaaatgccacagcctagagaagtcgaaggacacgggctgtattattgngcgagagactacccgaaggtcgaacctacgttggtcgtcttttgattttcgtggtcggggaccaaaggggaccaagtcggtccaccggttctcttcgacgtccctccaaccgaaacgggccccagtccccgggttcccttcccccgtgggcccgttcccttacggcctccgaacgggaccncccacccgtccggaagaacg

SEQ ID NO: 393328 - DNA, 598 bp, Homo sapiens
  misc_feature: GZ8MTXP01BVH74.38.28.C06.1.454.CMB.2.raw
  modified_base (306)..(306): a, c, t, g, unknown or other
  modified_base (366)..(366): a, c, t, g, unknown or other
  modified_base (380)..(380): a, c, t, g, unknown or other
  modified_base (411)..(411): a, c, t, g, unknown or other
  modified_base (417)..(417): a, c, t, g, unknown or other
  modified_base (424)..(424): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcgttttcttagtggctattttaaaaggtgtccagtgtgaggtgcaggtgtcggagtctgggggaggcttggttcagcccggggggtcctgagactctcctgtgcagtctctggattaaccttagtgactatgccatgatctgggtccnccaggctccgaggggaaggggctgggagtggggtctcgagcaaattaatggtagggggtnatcacataatacgnagacgtcgggtggggccgtcacatcacaganacaacncgagganacacactatactactaacgaaagtcgacacacgaccgtacgagacggtacggacggaccgaccggtaccggtacgttaagttagttaggtacggacggtacggaacgacgttacccgttaaccggtaaccggtacccgtaaccgttacggttcggttcgtttcgtttcgtttcg

SEQ ID NO: 393329 - DNA, 618 bp, Homo sapiens
  misc_feature: GZ8MTXP01CQPY3.38.28.C06.1.454.CMB.2.raw
  modified_base (273)..(273): a, c, t, g, unknown or other
  modified_base (335)..(335): a, c, t, g, unknown or other
tcagtcgatcacgtcacgaccggtgctcgatttagagctcacgtattgggtttgggctgagcgtggcgttttctagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtagggggtnatcacatatacgcagacgtcgggtgggggccgtcacatcaccagacgacaactccgaggacncaacatatatactaaacaaatcgaccacagctagagaagtcgaaggacacgggtcgtagtattagttgcgacgagacgactacccgaacggtcgaccctacgttggtcgttctttgttagttcgttcgtacggggtacgtaacggtaacgtaagtacgtcgtaccgtcttcttcgtacgtcctacccaccgaaccggacccgttacgtccgttcccgttccccgtccggttcccgttcccgttccgtccgtccgaacggacgccgacccgtcccgaacgaacg

SEQ ID NO: 393330 - DNA, 585 bp, Homo sapiens
  misc_feature: GZ8MTXP01BEZTT.38.28.C06.1.454.CMB.2.raw
  modified_base (502)..(502): a, c, t, g, unknown or other
tcagtcgatcacgtcacgaccggtgctcgatttagagctcacgtattgggtttgggctgagcgtggcttttcttagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtggggtctcagcaattaatgggtaggggtgattcaccatattacgcagactccggtggggggccgttcaccatcaccagagacaactccaggagcacactatatctaacaaatgccacagcctgagaagtcgaaggacacgggcccgtgtattattggtgacgagagataccgaacggtacgaccgaccttggtgtcgtttgttatttcttgttggggccgaagggacgaagtgtcgtaccgtcttcttctacgcctccnccgaacggcccgactccggttccgttccccgttccggccgcccgttcggcctcccgaacggacggcgacccgtccgcggaacg

SEQ ID NO: 393331 - DNA, 546 bp, Homo sapiens
  misc_feature: GZ8MTXP01D5Z5B.38.28.C06.1.454.CMB.2.raw
  modified_base (185)..(185): a, c, t, g, unknown or other
  modified_base (263)..(263): a, c, t, g, unknown or other
  modified_base (301)..(301): a, c, t, g, unknown or other
  modified_base (340)..(340): a, c, t, g, unknown or other
  modified_base (450)..(450): a, c, t, g, unknown or other
  modified_base (459)..(459): a, c, t, g, unknown or other
  modified_base (495)..(495): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcgttttctagtggctattttaaaaggngtcagtgtgaggtgcaggtgtcggagtctgggggagcttggttcagcccgggggtcctgagctctcctgtgcagtctntggattaaccttagtgactatgccatgatctgggtccnccaggctccgaggggaagggcgtggagtgggtcgtcagnaataagtaggtagggtggattcaccataattacgcagacgtccggtcgggggtccgggttcgacactacaccagagacaacaccagagcacactatatactacaaagtanacacacgcngagagacgacggacgacggcgtgtaattagttgtgngagagacgttccgacggtaacgaccgtaaccgttgtgttcgtttgttgttg

SEQ ID NO: 393332 - DNA, 598 bp, Homo sapiens
  misc_feature: GZ8MTXP01CF0VJ.38.28.C06.1.454.CMB.2.raw
  modified_base (217)..(217): a, c, t, g, unknown or other
  modified_base (276)..(276): a, c, t, g, unknown or other
  modified_base (503)..(503): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctggggggaggcttggttcagcctgggggggtccctgagactctcctgtgcagtctctggattaacctttagtgactatgccatgatctggggtccnccaggctccaggggaaggggctggagtggggtctcagcaaattaagtgggtagggggtnattcaccatattacgcagactccggtggggggccgttcaccatcaccagagacaactccaaggacgcacactatatctaacaaatgaccacagcctgagaagtccgaagggaccacgggccgttagtattatggtgacgagagactacccgaaacggttcgacctaccgttggtgtctttgtatttcgtggttcggggaccgaaaggggacaaagtggtccaccgtntccttcagccctccaccgaacgggcccttagtccggttccttcccccgtggggcccgccttcggcctaccgcggacgcccactcccgaagaaccg

SEQ ID NO: 393333 - DNA, 641 bp, Homo sapiens
  misc_feature: GZ8MTXP01DCUV9.38.28.C06.1.454.CMB.2.raw
  modified_base (256)..(256): a, c, t, g, unknown or other
  modified_base (278)..(278): a, c, t, g, unknown or other
  modified_base (344)..(344): a, c, t, g, unknown or other
  modified_base (419)..(419): a, c, t, g, unknown or other
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagactctcctgtgcagtctctggatttaacctttagtgactatgccatgatctggggtccgccagggctccaggggaagggggctgggagtggggtctanagataattagtgggtaggggtnactcacatatacgcagaccgtccgggtgggggtccgtcaccatccaacagacacaactcgaggacncacatatatactaacaaagtacaccacacgactagagaacgacgaacggacgacggtacgtagtattagttgtgngagagacgtaccgaacggtacgaccgtaccgttcggttcgttcgtttgttagtttcgttcggtacggggtacggtaacggtaacgtaacgtacgtccgtaccgttcttcttctcgtacctacccgaccgaaccggccgttaccgtccgttcccgttccccgtccgttcccgttcccgttccgtccgtaccgaaccggacgaccgaccgtaaccgaacgaacg

SEQ ID NO: 393334 - DNA, 659 bp, Homo sapiens
  misc_feature: GZ8MTXP01DX0GW.38.28.C06.1.454.CMB.2.raw
  modified_base (216)..(216): a, c, t, g, unknown or other
  modified_base (274)..(274): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaaggggctggagtgggtctcagcaaattaagtgggtagggggtnatcacatatacgcagacgtcgggtgggggccgtcaccatccacgagacgaacaactcgaggacacaacaactaatatactaaacaaatcgacccaacacgcctaggaacggaacgtacggaagggaccgaccggggtccgttagttaatttagttggtgacgagacgactacccgaacggtcgaacccgtacgtttggtcgttcgtttgtatttcgtggtacggggaacgtaaaggggtactaagttcggtacctaccgttcttacctctacgtccctacccgaaccggaaccggtcccttacgttcccggttccccgttcccccgtcggccccgttcccgttacgcccgtaccgaacgggaccgcccgacccgtccgaagaacg

SEQ ID NO: 393335 - DNA, 577 bp, Homo sapiens
  misc_feature: GZ8MTXP01EQ9MK.38.28.C06.1.454.CMB.2.raw
  modified_base (278)..(278): a, c, t, g, unknown or other
  modified_base (291)..(291): a, c, t, g, unknown or other
  modified_base (326)..(326): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgtgctcaactgtcttgtccaccttgctgagcgtgcgttttctagtggctatttaaaaggtgtcagtgtgaggtgcaggtgtcggagtctgggggaggcttggttcagcctgggggtccctgagctctcctgtgcagtctctggattaaccttagngactatgccatgntctggtccgccgagctccgagggaaggggcgtggngtggtcgtcagcaataatggtaggggtggattcaccaaatattaacgcagaacgtccggtcgggggtccgggttcgtaccacacacccaggacgaacaactacccgaggacgacacacctaataatacttaaccaaattaagacacacgcgagagacgacggacggacgacggtcgtaagttagttagttgttgacggagacgacgttaccgaacgtacgtaaccgtacgttcggttcgttcgtttcgttg

SEQ ID NO: 393336 - DNA, 640 bp, Homo sapiens
  misc_feature: GZ8MTXP01AK5SU.38.28.C06.1.454.CMB.2.raw
  modified_base (271)..(271): a, c, t, g, unknown or other
  modified_base (332)..(332): a, c, t, g, unknown or other
  modified_base (394)..(394): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtnattcacatatacgcagactccggtggggggccgttcaccatcaccagagacaactcaggancacactatatctaacaaatcgccacagcctagagaagtcgaagacacgggctgtattattgngcgagagactacccgaaggtcgaccgtacgttggtcttctttgtactttcgtggtacggggaccgaaaggggtactaacgttcggtacccgtacccgttccttccttaccgaccgtaccccgtaccccgaacccgtaacccgggtacccgttaccgttcccggttccccgttcccccgtcccggttcccggttccccgttccgtcccgtccgaaccggaccgaccgacccgtaacccgaacgaacg

SEQ ID NO: 393337 - DNA, 596 bp, Homo sapiens
  misc_feature: GZ8MTXP01BGNEQ.38.28.C06.1.454.CMB.2.raw
  modified_base (158)..(158): a, c, t, g, unknown or other
  modified_base (263)..(263): a, c, t, g, unknown or other
  modified_base (304)..(304): a, c, t, g, unknown or other
  modified_base (328)..(328): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgngtttctagtggctatttaaaaggtgtcagtgtgaggtgcaggtgtcggagtctgggggaggcttggttcaggcccgggggtcctgagactctcctgtgcagtctntggattaaccttagtgactatgccatgatcgtgggtccccncgagctcggaggggagggcgtggnggtggtcgtgagataagtagtggtaggtagtatacactataatacgcgacgtacgtcgggtcggggtccggtacgacacacacgacgacgacaacacgacgacgacaacaactataactaactaacaaacgtacgacgaacgacgacgtagagaggacggaacggacggaccggtaccggtagttaagttagttggtggacggagaacgacgttaccgaccggtaaccgtaccgtaaccgttcggttcgttcgtttcgtttcgtttcg

SEQ ID NO: 393338 - DNA, 528 bp, Homo sapiens
  misc_feature: GZ8MTXP01B9C2U.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccacctctcctgcagggccagtcagagtgtttcaacggctacttagcctggtaccagcaaaacctggccaggctccaggctcctcatctatggtacatccgtcagggccactggtactcccagacacggttcagtggcagtgggtctggggacagacttcactctcaccatcagcagactggaggctgaagtatttgctagtgtagttactgtcagcagtatactacaagtaccgtactactttggccaagggggttaccaaaggctagggacgaaccgaaacgaactgtaggctggcacctaattcgttcg

SEQ ID NO: 393339 - DNA, 568 bp, Homo sapiens
  misc_feature: GZ8MTXP01BL9MA.38.28.C06.1.454.CMB.2.raw
  modified_base (158)..(158): a, c, t, g, unknown or other
  modified_base (182)..(182): a, c, t, g, unknown or other
  modified_base (260)..(260): a, c, t, g, unknown or other
  modified_base (314)..(314): a, c, t, g, unknown or other
  modified_base (319)..(319): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgngtttctaggtggctatttaaaggngtcagtgtgaggtgcaggtgtcggagtctgggggagcttggttcagcccgggggtcctgagctctcctgtgcagtctntggattaaccttagtgactatgcatgatctggtcgccagctccaggaagggggngtggngtggtcgtcgagataagtagtaggtacggtagtatacactataactacgcgacgtacgtcgggtcggggtccggtacgacgactacacgacgacgacacgacgacgacgacacactactactactaactaacgtacgacacgacgacgtagacgacgacggacggtacgacggtacgtgttaagttagttgtcgcgacgacgacgttaccgacggtaacgtacgtcgttcgtcgttcgttcgttcgttg

SEQ ID NO: 393340 - DNA, 611 bp, Homo sapiens
  misc_feature: GZ8MTXP01B7AAN.38.28.C06.1.454.CMB.2.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtagggggtgattcaccatattacgcagactccggtggggggccgttcaccatcaccagagacaactccaggagcacactatatctaacaaatgccacagccctgagaagtcgaaggacacgggccgtgtatttattgtgcgagagatccccaagggtgaacccactttgggtgtcttttgattttcgtggttgggggcccgtaaagggggccaaagttgggtaccacccggttcttcctttcagcccctccaacccgaaggggcccccaagttcccgggttccctttcccccccgtggggccccgccccttaggcccttcccgaagggacgccaccccgtccggaagaacg

SEQ ID NO: 393341 - DNA, 706 bp, Homo sapiens
  misc_feature: GZ8MTXP01D8LWM.38.28.C06.1.454.CMB.2.raw
  modified_base (688)..(688): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtcagtgtgaggtgcaggtgtcggagtcgtgggggaggcttggttcaggcccggggggtccctgagactctcctgtgcagtctctggtattaacctttagtgactatgccatgatcgtgggtcccgccaggctccgagggggaagggggctgggagtgggtctcgagactaaagttaagtggggttaacgggggtgtatttccaacctaattaaacgtttaaccgcgtaaacgggtaaccgttcccgggggttcggggggggtaccccggtttaccaaacccgtaacgtcccaaaccccgaaggaacgaaaccaaaccttaccccgaaaggggacacccaaaccaaaccgttaaattaacttaaccctaaacctaaaaagttcggaaccaaaccgaacggacccttaggaagacggttaccgggaaggaccgaaccgggtccgtagttaattaagttggtcgacgaagacgacgttccccgaaaggtcgaccctaacgttggngttcttttgaagttttcg

SEQ ID NO: 393342 - DNA, 548 bp, Homo sapiens
  misc_feature: GZ8MTXP01CJLK0.38.28.C06.1.454.CMB.2.raw
  modified_base (282)..(282): a, c, t, g, unknown or other
  modified_base (305)..(305): a, c, t, g, unknown or other
  modified_base (365)..(365): a, c, t, g, unknown or other
  modified_base (429)..(429): a, c, t, g, unknown or other
  modified_base (451)..(451): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaatttaaaggtgtcagtgtgaggtgcaggtgtcggagtcgtgggggagcttggttcacggcccgggggtcctgagactctcctgtgcagtctctggtattaacctttagngactatcgcatgatcgtggtccncgaggctcgagggggaggctgggagtgggtctcgagactaaagttaagtgggtacgggtnattcactataatacgcagacgtcgggcggggccgtcacgatcacagacgacaacgtcgaggacncacactatatacctaagtaaanacacacacgacgagagagacgacgtacgacgtcgtgtaagtgttgtgagagacgacgccgacgtaacgtacgtcgttcgtcgttcgttcgttcgttg

SEQ ID NO: 393343 - DNA, 574 bp, Homo sapiens
  misc_feature: GZ8MTXP01BHSCQ.38.28.C06.1.454.CMB.2.raw
  modified_base (271)..(271): a, c, t, g, unknown or other
  modified_base (562)..(562): a, c, t, g, unknown or other
  modified_base (571)..(571): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtggggtctcagcaattaatgggtaggggtnattcaccatattacgcagactccgtggggggccgttcaccatcaccagagacaactccaaggagcacactatatctaacaaatgaccacagcctgagaagtcgaaggacacgggccgtgtattattgtgcgagagactcccaacgggtgacccacctttggtgtcttttgattttcgtggttcggggaccctaaaggggaccaaagtgggtaccaccggttctacttcagccctccaccaagggccccagtccggttctcccccgtggccgcccttgcctccgaaggaccncaccgtcgngcg

SEQ ID NO: 393344 - DNA, 602 bp, Homo sapiens
  misc_feature: GZ8MTXP01CUXM0.38.28.C06.1.454.CMB.2.raw
  modified_base (341)..(341): a, c, t, g, unknown or other
  modified_base (496)..(496): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggctttttcttgtggctaattttaaaaggtgtccagtgtgaggtgcaggtgtcggagtcgtgggggagcttggttcaggcccggggggtccctgagactctcctgtgcagtctctggattaaccttagtgactatgccatgatcgtgggtccgccaggctccgagggagggctgggagtgggtcncgagactaaagttagtggggtacggggtgatttcaaccgtataaacttacgcagtaccgtccggggtcggggggccgttcaccataccacgagacgaccaacgtccgagggacacaacactatactacgtaaacaaatcgacacacgcctgaagngtaccggagtacgaccggccgtgtaattagttggtagcgaaagagttaccgttcccgaacggtcacccgtaacgtttgggtcttcgttttaagttaagttttccgg

SEQ ID NO: 393345 - DNA, 563 bp, Homo sapiens
  misc_feature: GZ8MTXP01CJ4MZ.38.28.C06.1.454.CMB.2.raw
  modified_base (214)..(214): a, c, t, g, unknown or other
  modified_base (416)..(416): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccacctctcctgcagggccagtcagagtgttttcaacggctacttagcctggtaccagacaaaaactggccaaggctcccaggctcctcatctatggtacatccgtcagggccactggtatcccagacaggttcagtgcagtgggtctgggacagacttcactctcaccatcagcagactgggagctagaagtatttganagtgttattactgtcagcaagtactactaacaagtaaccgtactacgttttggaacccgtaagggggacccaaaggccgttaagggaacgaaacccgaaaacgaaaccttaagggacgggtctacggcaaccctaagttctttccgg

SEQ ID NO: 393346 - DNA, 606 bp, Homo sapiens
  misc_feature: GZ8MTXP01CF62X.38.28.C06.1.454.CMB.2.raw
  modified_base (273)..(273): a, c, t, g, unknown or other
  modified_base (333)..(333): a, c, t, g, unknown or other
  modified_base (359)..(359): a, c, t, g, unknown or other
  modified_base (551)..(551): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaagggctgggagtgggtctcagctaaattaagtgggtaggggtnattcacatatacgcagactcggtgggggccgttcaccatcaaccagagacaactcaggancacactatatctaacaaatgacccanagcctgagaagtcgaaggacacgggccgtgtattagtgtgacgagagactcccgaaaggtcgaacctaccgttggtgttctttgatttcgtggttcggggacctaaaggggacaagttcggtaccaccgttctccttcgacgtccctaccaaccgaacgggccccttagttccgggttccctttccccccgngggccccgcccgttcgccccgtcgaacgggtcgcccaacccgtccggaagaaccg

SEQ ID NO: 393347 - DNA, 643 bp, Homo sapiens
  misc_feature: GZ8MTXP01EKTKL.38.28.C06.1.454.CMB.2.raw
  modified_base (334)..(334): a, c, t, g, unknown or other
  modified_base (448)..(448): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagtgggtaggggtgattcacatattacgcagactccggtggggggcccgttcaccatcaccagagacaactccaggancacactatatctaacaaatgaccacagcctgagaagtcgaaggacacgggcctgtattatgtgcgagagactcccaacggtgaacccaccgtttgggtgtcttttgattttcgngggttggggaccctaaagggggaccaaagttcgggtaccaacccggttcttcctttcaacggtcccctacccaacccgaaacgggggcccccttaaggttcccgggtttccccttccccccgttggggccccgttccccttgggccccttcccggaaacgggccggacccaacccgttccccggaagggaacccg

SEQ ID NO: 393348 - DNA, 595 bp, Homo sapiens
  misc_feature: GZ8MTXP01EU1IA.38.28.C06.1.454.CMB.2.raw
  modified_base (286)..(286): a, c, t, g, unknown or other
  modified_base (309)..(309): a, c, t, g, unknown or other
  modified_base (370)..(370): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctaggtggctaattttaaaaggtgtccagtgtgaggtgcaggtgtcggagtcgtgggggagcgttggttcgacggcccgggggtcctgagactctctgtgcagtctctggattaaccttgngactatgccatgatctggtcccncaggctccgagggaagggctgggagtgggtctcgagctaaagttaagtgggtacgggggtntatttccaaccattaacttacgcgtaaggaaccgtccggggtcggggggtcccgttacaacccgtatccaacccgaggaacgtaacaaacccgacgaaggacacaactactatactacgtaacaaggacacacacgcgagagacgacgacggtacgacgtcgtgtaagttagttgtgagagacgacgttccgacgtcgtacgtcgttcgtcgttcgttgttgttg

SEQ ID NO: 393349 - DNA, 606 bp, Homo sapiens
  misc_feature: GZ8MTXP01DL8BO.38.28.C06.1.454.CMB.2.raw
  modified_base (218)..(218): a, c, t, g, unknown or other
  modified_base (276)..(276): a, c, t, g, unknown or other
  modified_base (326)..(326): a, c, t, g, unknown or other
  modified_base (332)..(332): a, c, t, g, unknown or other
  modified_base (351)..(351): a, c, t, g, unknown or other
  modified_base (360)..(360): a, c, t, g, unknown or other
  modified_base (395)..(395): a, c, t, g, unknown or other
tcagtcgatcacgtcacgaccggtgctcgatttagagctcacgtattgggtttgggctgagcgtgcgttttctaggtggctattttaaaaggtgtccagtgtgaggtgcaggtgtcggagtctggggggaggcttggttcagcctgggggggtccctgagactctcctgtgcagtctctggatttaacctttagtgactatgccatgatctgggtccnccaggctccaggggaaggggctgggagtggggtctcagcaattaatgggtagggggtnactcacatatacgcagcgtcgggtgggggccgtcacatcacagacacacncgagancacactatatcaacaatcnccacagtcngagaagcgaaggacacgggtcgtgtattagttcgngagagagactaccgaacggtcaccgtacgttggtcttctttgttagttcgttgtacggggtacgtaacggtaacgtaacgtacgtcgtaccgtcttcttcgtcgtacctaccgaccgaaccggtaccgttaccgtccgttcccgttccccgtccggttcccgttcccgttccgtccgtaccgaacggacgaccgacccgtccgaacgaacg

SEQ ID NO: 393350 - DNA, 512 bp, Homo sapiens
  misc_feature: GZ8MTXP01CQMNG.38.28.C06.1.454.CMB.2.raw
  modified_base (213)..(213): a, c, t, g, unknown or other
  modified_base (302)..(302): a, c, t, g, unknown or other
  modified_base (386)..(386): a, c, t, g, unknown or other
  modified_base (481)..(481): a, c, t, g, unknown or other
  modified_base (506)..(506): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaaanagccacctctcctgcagggccagtcagagtgtttcaacggctacttagcctggtaccagacaaaacctggccaggctcccaggctcctnatctatggtacatccgtcagggccactggactcccagacaggttcagtgcagtgggctgggacagacttcactctcaccatcancagactggagctgaagatttgctagtgtagttaactgtcagctagtatactaacaagtacctactactttcggctaggggacctaagcgtagganaccaaagaactgaggctgcttaccngttctg

SEQ ID NO: 393351 - DNA, 526 bp, Homo sapiens
  misc_feature: GZ8MTXP01A2JMT.38.28.C06.1.454.CMB.2.raw
  modified_base (191)..(191): a, c, t, g, unknown or other
  modified_base (317)..(317): a, c, t, g, unknown or other
  modified_base (384)..(384): a, c, t, g, unknown or other
  modified_base (386)..(386): a, c, t, g, unknown or other
  modified_base (517)..(526): a, c, t, g, unknown or other
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggcttttctgtggctattttaaagctcgtggggccgttnaccatcaccagagacaactccaggagcacactatatctacaaatgcacagcctgagagtcgaggacacggcgtgtatatgtgcgagagactcccgaacggtgaccaccttggtgcttttgatttcngtgccaagggacaagtgtcactctcttcacgctccaacacgccgactcgtctccctcgcgccgtccncncacgcgcaccgcgacgacgacacgacgcgccgcggcgcggcgtcggtacgaacgaaccgtaccgtaccgtacgtacgtacgtacgtacgtacggcggcgggcggttcgggacggacggacggacgagttgnnnnnnnnnn

SEQ ID NO: 393352 - DNA, 680 bp, Homo sapiens
  misc_feature: GZ8MTXP01BQ8TV.38.28.C06.1.454.CMB.2.raw
  modified_base (215)..(215): a, c, t, g, unknown or other
  modified_base (269)..(269): a, c, t, g, unknown or other
  modified_base (304)..(305): a, c, t, g, unknown or other
  modified_base (317)..(317): a, c, t, g, unknown or other
  modified_base (322)..(322): a, c, t, g, unknown or other
  modified_base (339)..(339): a, c, t, g, unknown or other
tcagtcgatcacgtcacgaccggtgctcgatttagagctcacgtattgggtttgggctgagcgtgcgttttctagtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaagggctggagtgggtctcagctaattaatggtaggggtnatcactatatacgcagacgtcggtggggcctcacnncacagacacacncaganacacactatatactaanaagtgaccacagcgtagagtaacgtacgaacgggacgtacgggtccgttagttaagtttagttggtacgacgagtaacgtaacgtacccgtaaccggtaccggtaaccgttaccgttacggttcgtttcgtttacgttacgtttacgttcggttacggggtacggtaacggtaacgtaacgtacgtaccgtaccgttaccgttccttaccgtaccgtacccgtacccgtaacccgtaaccggtacccgttaccgtcccggttccccgttccccgtcccggttcccgttcccgttcccgtccgtccgtaaccggacgaccgttacccgtaaccgaacgaacg

SEQ ID NO: 393353 - DNA, 509 bp, Homo sapiens
  misc_feature: GZ8MTXP01AETHC.38.28.C06.1.454.CMB.2.raw
  modified_base (214)..(214): a, c, t, g, unknown or other
tcagtcgatcacgtcacgaccggtgctcgatttagagctcacgtattgggtttgggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagngccacctctcctgcagggccagtcagagtgtttcaacggctacttagcctggtaccagcaaaacctggccaggctcccaggctcctcatctatggtacatccgtcagggccactggtatcccagacacggttcagtggcagtgggtctgggacagacttcactctcacccatcagcagactggagctgaagatttgctagtgtaagttactgtcagcagtatactacaagtccgtactactttggccaggggacaagcgtaggacacgaaagacgtgtagctgcactaattctcg

SEQ ID NO: 393354 - DNA, 658 bp, Homo sapiens
  misc_feature: GZ8MTXP01BU0G6.38.28.C06.1.454.CMB.2.raw
  modified_base (325)..(325): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttattttaaaaggtgtccagtgtgaggtgcaggtgtcggagtcgtgggggaggcttgggttcgacgggtccccgggggggtccctggacgactctcctgtgcagttctcgtggatttaacctttagtgactatcgccatgatcgtgggtcccncgaggcctccgaggggaaggggctgggagtgggtctcgagactaaattagtggggtaggggtgtattcaacctattaacgttacgcgtaaacggtaccgttcccggggtcgggggggtccccgtttacgaacccgtactccgaacccgaaggaacgaaccaaaccgtacccgaaggacgaccaacaactaatactactaaacaaagtcgacaacacgcctagagacggtacgaggaccgacgggtccgtgtaattagttggtcggacgaaggacgacgttcccgaacggtccgacccgtaaccgttggtcgttcgttttgttaacgttttcgg

SEQ ID NO: 393355 - DNA, 537 bp, Homo sapiens
  misc_feature: GZ8MTXP01ESKB3.38.28.C06.1.454.CMB.2.raw
  modified_base (213)..(213): a, c, t, g, unknown or other
  modified_base (530)..(530): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaanagccaccctctcctgcagggccagtcagagttgttttcaacggctacttagcctggtaccagacaaaactggccaggctcccaggctcctcatctatggtacatccgtcacgggccacgtggtactcccgagacacggttcagtggcagtgggtctgggacagacttcactctcacatcagcagacgtggaagctagaagtatttgctagtgtattactgtacagcagtatactaacgaagtaaccgtactacgtttggaaccgtaacggggaccaagcgtagggaacaccgaaacgaacgtgacggctcggcactnttcgtcg

SEQ ID NO: 393356 - DNA, 571 bp, Homo sapiens
  misc_feature: GZ8MTXP01BETLM.38.28.C06.1.454.CMB.2.raw
  modified_base (334)..(334): a, c, t, g, unknown or other
  modified_base (417)..(417): a, c, t, g, unknown or other
  modified_base (432)..(432): a, c, t, g, unknown or other
  modified_base (558)..(558): a, c, t, g, unknown or other
  modified_base (568)..(568): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtgattcacatattacgcagactccggtggggggccgttcaccatcaccagagacaactccaggancacactatatctaacaaatgccacagcctgagaagtcgaaggacacgggccgtgtattatgtgcgagagactcccaaacggtnaccctacgtttggtntcttttgatttctggtcggggacctaaggggacctaagtcggtcaccgttctacttcacgccctccaaccgaacgggccccagtcccggttccttccccgtggccgcccttgctcccgaaggaccnccaccgtcgngcg

SEQ ID NO: 393357 - DNA, 564 bp, Homo sapiens
  misc_feature: GZ8MTXP01BTMC1.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcacctgtctttgtctcgaggggaanagccacctctcctgcagggccagtcagtagttgtttcaacggtctacttagcctggtacagacaaaactgcagctccagctctcatctatgtacatccgtcacgggccacgtggtactccagactacggtcagtggcaggtgggtctgggacagacttcactctcaccatcagcagacgtggagctagaacgtatttgctagtgttattacgtgtacagctaagtactactaacgaacgtaccgttactacgtttcgggaaccgtaacgggggttaccaaacggttcgtagggaacgaaacccgaaacgttacgtggtacgggctcggaccttaaccgtaattcgttaaccg

SEQ ID NO: 393358 - DNA, 577 bp, Homo sapiens
  misc_feature: GZ8MTXP01BSNIQ.38.28.C06.1.454.CMB.2.raw
  modified_base (270)..(270): a, c, t, g, unknown or other
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccaggggaaggggctggagtgggtctcagcaattaatgggtaggggtnattcacatatacgcagactcggtgggggccgttcaccatcaccagacgacaactccaaggacncacactatatctaacaaatgaccacagcctgagagtcgaaggacacgggcgtgtattagtgtgcgagagactccgaacggtcgacctacgttggtacgtcttttgatttctggtggggaccgtaaggggacaagtcggtcaccgttctcttcacgtccctccaaccgaacgggcccagtcccggttccttcccccgtggcccgcccttcgcctccgaacggacgtccacccgtccgaagaaccg

SEQ ID NO: 393359 - DNA, 570 bp, Homo sapiens
  misc_feature: GZ8MTXP01AON4S.38.28.C06.1.454.CMB.2.raw
  modified_base (282)..(282): a, c, t, g, unknown or other
  modified_base (285)..(286): a, c, t, g, unknown or other
  modified_base (311)..(311): a, c, t, g, unknown or other
  modified_base (313)..(313): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgtttctaggtggctatttaaaaggtgtccagtgtgaggtgcagtgtcggagtctgggggagcttggttcagcccgggggtcctgagctctcctgtgcagtctctggataaccttagtgactatncanntgtcggtcgcgcgcgcgagggaggngnggtggtggtcgtcgagataagtaagtaggtacggtagtatacactataatacgcgacgacgtcgggtcggggtcggtcgacacacacgacgacgacgaacacgacgacgacacactataactactaacaacgtacgacacacgacgtagagacggacggacgacgacggtcgtgtaagttagttgtcgacgacgaacgaccgttacccgaccggtaaccgtaccgtaaccgttcggttcgttcgtttcgttcgttcg

SEQ ID NO: 393360 - DNA, 622 bp, Homo sapiens
  misc_feature: GZ8MTXP01DB874.38.28.C06.1.454.CMB.2.raw
  modified_base (214)..(214): a, c, t, g, unknown or other
  modified_base (335)..(335): a, c, t, g, unknown or other
  modified_base (404)..(404): a, c, t, g, unknown or other
  modified_base (562)..(562): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctgggagtgggtctcagctaaattaagtgggtaggggtgattcacatatacgcagactccggtgggggccgttcaccatcaccagagacaactccaggancacactatatctaacaaatcgaccacagcctaggagaagtcgaaggacacgggtccgtagtattattgngcgagagactacccgaaggtcgaacctaccgtttggtgtcttttgactttcgtggtcggggacccgtaaaggggtaccaagttcggtacctaccgtcttcttcgacgtccctacccaaccgaaacgggccccaaggttcccggttccctttcccccgngggccccgttccccttcggccctacccgaagggaccgccaaccccgtccggaaggaaccg

SEQ ID NO: 393361 - DNA, 499 bp, Homo sapiens
  misc_feature: GZ8MTXP01DBYK1.38.28.C06.1.454.CMB.2.raw
  modified_base (311)..(311): a, c, t, g, unknown or other
  modified_base (485)..(499): a, c, t, g, unknown or other
tcagtcgatcacgtcacgaccggtgctcgatttagagctcacgtattgggtttgggctgagctggctttttcttgtggctattttaaagactccgtgggggccggttcaccatcaccagagacaactccaggagcacactatatctacaaatgcacagcctgagagtcgaggacacggccgtgtattattgtgcgagagactcccaacggtgaccacttggtgtcttttgatttctgtggaccaagggacaagtggtcaccgtctctcagccctccaccagggccccatccggtccttcccccgtggcccnccctgcctccgaggacgccaccctccgagacgccacgaggcccggccctggggccttacggcccccgttgggtacaaacgggtacccttaccgtttccccgaacggttggaacttaccgggaccgttgggaacggccggggggtctcggggacaacggggtccacgtagtaggnnnnnnnnnnnnnnn

SEQ ID NO: 393362 - DNA, 595 bp, Homo sapiens
  misc_feature: GZ8MTXP01BG0HZ.38.28.C06.1.454.CMB.2.raw
  modified_base (304)..(304): a, c, t, g, unknown or other
  modified_base (436)..(436): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtcgtgggggaggcttggttcaggcccggggggtcctgagactctcctgtgcagtctctggattaaccttagtgactatgccatgatctggtccncaggctcgaggggaagggctggagtgggtctcgagcaagttaagtgggtacggggtgattcacctataacttacgcagacctccgggtggggggcccgttcaccgatccaccgagagacaactccaagggancaacactaatactacttaaaccaaatcgaccaacacggacccgttagacggagtaccggaagggacctaccgggcaggttaaggttaatttagttcggttgacggtagagacttacccgaacgggtcaaccctacggttggttcgtcgttttggtaacg

SEQ ID NO: 393363 - DNA, 416 bp, Homo sapiens
  misc_feature: GZ8MTXP01DQOBN.38.28.C06.1.454.CMB.2.raw
  modified_base (411)..(411): a, c, t, g, unknown or other
  modified_base (413)..(413): a, c, t, g, unknown or other
  modified_base (415)..(416): a, c, t, g, unknown or other
tcagtcgatcacgtcacgaccggtgctcgatttagagctcacgtattgggtttgggctgagctggcttttcttgtggctattttaaaagactccgtgggggccggttcaccatcaccagagacaactccaggagcacactatatctacaaatgcacagcctgagagtcgaggacacggccgtgtattattgtgcgagagatcccaacggtgaccaccttggtgtcttttgatttctgtggccaagggacaatggtcacccgtctcttcagcctccaccaagggcccatccggtccttccccctggccgccctgcctccaggacgccacctccgagagcacagcggccctggggctcgcccctggtcaaggctacttcccacgtgatcgactgagcgggctggcaagggcanangnn

SEQ ID NO: 393364 - DNA, 667 bp, Homo sapiens
  misc_feature: GZ8MTXP01CLR68.38.28.C06.1.454.CMB.2.raw
  modified_base (336)..(336): a, c, t, g, unknown or other
  modified_base (400)..(400): a, c, t, g, unknown or other
  modified_base (408)..(408): a, c, t, g, unknown or other
  modified_base (637)..(637): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcaggccgtggggggtccctgagactctcctgtgcagtctctggattaacctttagtgactatgccatgatctggtccgccaggctccgaggggaaggggctggagtgggtctcagctaattaagtgggtaggggtgattcaccatatacgcagacgtcggtgggggccgtcaccatcaccagagacaactccgaggancaacactatatactaacaaatgaccacagctgagaagtcgaagacacggcgtagtattagttgngacgaganactacccgaaggttcacctaccgttggtactcgtttgtactttcgtaggttcggggaacccgaaaggggtacctaagttcgggtccctaaccggttcttaccgttcccaacggtcccctcccgaaacccggtaaaccggggacccccttaggttcccccgggttccctttccccccccggtgggccccccggttccccttaccggcccgttacccgaacggggaccccnccccgttacccgtaacccggaacggaaccg

SEQ ID NO: 393365 - DNA, 545 bp, Homo sapiens
  misc_feature: GZ8MTXP01BZLPW.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangccacctctcctgcagggccagtcagagttgttttcaacggtctacttagcctggtaccagacaaaactggccaggctcccaggctcctcatctatggtacatccgtcagggccacgtggtactcccagacaggttcagtggcaggtgggtctgggacagacttcactctcaccatcagcagactgggaggctagaagtatttgctagttgttattacgtgtacagcaagtatactaacgaagtaccgtactacgtttcggaaccgtaacggggaccaaggcgtagggaacgaaccgaaacgacgtggtcggctgcaccgtaacttcgtcg

SEQ ID NO: 393366 - DNA, 592 bp, Homo sapiens
  misc_feature: GZ8MTXP01EW4BC.38.28.C06.1.454.CMB.2.raw
  modified_base (214)..(214): a, c, t, g, unknown or other
  modified_base (272)..(272): a, c, t, g, unknown or other
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctgggagtgggtctcagcaattaagtgggtaggggtnattcacatatacgcagactcggtgggggccgttcaccatcaccagacgacaactccaggancacactatatctaacaaatgccacagcctgagaagtcgaaggacacgggcgttagtattagtgtcgcgagagactttacccgaacggtcgaacctaccgttggtcgtcgtttgtactttcgtggtcggggacgtaaagggaccaagtcggtccgtaccgttcttcttctacgtcctacccaaccgaacgggcccacgtccggttcccttccccgtcgcccgcccttcgcctccgaacggcgccaccgtccgaagaaccg

SEQ ID NO: 393367 - DNA, 537 bp, Homo sapiens
  misc_feature: GZ8MTXP01BU171.38.28.C06.1.454.CMB.2.raw
  modified_base (214)..(214): a, c, t, g, unknown or other
  modified_base (449)..(449): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccacctctcctgcagggccagtcagagtgtttcaacggtctactagcctggtaccagacaaaactgccaggctccaggctcctcatctatggtacatccgtcgacgggccacgtggtactcccagactacggttcagtggcaggtgggtctgggacagacttcactctcacatcagcagactggaggctagaagtatttgctagtgtattacgtgtcagctaagtatactaanaacgtacctactacgtttggaaccgtaggggaccaaaggcgtaggaacgaaccgaaacgttactggtagctagcaccgtaattcgtcg

SEQ ID NO: 393368 - DNA, 557 bp, Homo sapiens
  misc_feature: GZ8MTXP01DJEU3.38.28.C06.1.454.CMB.2.raw
  modified_base (214)..(214): a, c, t, g, unknown or other
  modified_base (417)..(417): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangccacctctcctgcagggccagtcagtagtgttttcaacggctactagcctggtaccagacaaaaacctggccaggctcccaggctcctcatctatcggtacactccgtcagggccacgtggtactcccagactacggttcagtggcaggtgggtctgggacagacttcactctcacatcagcagacgtggagtctagaagtntttgctagttgtattactgtcagcagtatactaacaacgtaccgtactacgtttcggaaccgtaacgggggaccaaaggcgtaacgggaacaaccgaaaacgaacgttggtaggtctcggaccaccgtaattcgttaacg

SEQ ID NO: 393369 - DNA, 631 bp, Homo sapiens
  misc_feature: GZ8MTXP01C8IWQ.38.28.C06.1.454.CMB.2.raw
  modified_base (198)..(198): a, c, t, g, unknown or other
  modified_base (278)..(278): a, c, t, g, unknown or other
  modified_base (364)..(364): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcaccatattacgcagactcggtgggggccgttcaccatcacagagacaactccaggagcacactatatctaacaaangcacagcctgagagtcgaggacacggcgtgtattatgtgcgagagactcccaaggtcgacctaccttggtgtcttttgattttcgngttcggcccaaaggggactaaagttgggtaccaccggttctccgttacacgccctacccaaccgaacgggccccacgttccggtcccttcccccgtggcccgcccctcgtccctccggaacggtacgcccacccgtccgaagacgccaacgacggcccgggtccccgtggggcctcggcccgttgggtaaccaaacgggtaccctttaaccgttcccgaacggttcggtaactccggaacgtgggacggcggggcgttcgggaaccg

SEQ ID NO: 393370 - DNA, 635 bp, Homo sapiens
  misc_feature: GZ8MTXP01D5EOF.38.28.C06.1.454.CMB.2.raw
  modified_base (214)..(214): a, c, t, g, unknown or other
  modified_base (335)..(335): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccncaggctccgagggaagggctggagtgggtctcagcaattaagtgggtagggggtgattcaccatattacgcagactccggtggggggccgttcaccatcaccagacgacaactccaggacncacactatatctaacaaatgccacagcctagagaagtcgaaggacacgggccttgtattagtgtgcgagagactacccgaacggtcgaaccctaccgtttgggtcgtcttttgatttcgtggttcggggacccgtaaaggggtaaccaagttcggtcctaccggttctacctttcacggtcccctccgaaccgaaacgggccccttaagttcccgggttcctttccccccgtgggccccgttccccgttcggaacccgttcccgaacggggaacccgcccgttacccgtccggaacggcg

SEQ ID NO: 393371 - DNA, 427 bp, Homo sapiens
  misc_feature: GZ8MTXP01EXZLG.38.28.C06.1.454.CMB.2.raw
  modified_base (421)..(427): a, c, t, g, unknown or other
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagatcccaacggtgaccaccttggtgtctttttgatttctgtggccaagggacaatggtcaccgtctcttcagcctccaccaagggcccatccggtccttcccccgtggccgcccctgcctcccgaggacgccaccctccgagacgcacgagccggccctgggctgcccctggtcaaggctactccacgtgatcgactgagcgggctggcaaggcgcatagnnnnnnn

SEQ ID NO: 393372 - DNA, 614 bp, Homo sapiens
  misc_feature: GZ8MTXP01BGTJB.38.28.C06.1.454.CMB.2.raw
  modified_base (273)..(273): a, c, t, g, unknown or other
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtggggtctcagcaattaatgggtagggggtnattcaccatatacgcagactccggtggggggccgttcaccatcaccagagacaactccaggancaacactatatctaaacaaatcgaccacagcctagagaagtcgaaggacacgggcgtgtattatgtgcgagagactcccgaagggtcacccgtacgtttggtgtcttttgattttcgtggtacggggaccgaaaggggaccaagttcggtcccaccgttctcttcgacgtccctaccgaaccgaacgggccccttagttcccggttaccttccccccgtgggcccgttccccttggccctacccggaagggtacgcccttaaccccgtccggaagccg

SEQ ID NO: 393373 - DNA, 726 bp, Homo sapiens
  misc_feature: GZ8MTXP01DG0FD.38.28.C06.1.454.CMB.2.raw
  modified_base (187)..(187): a, c, t, g, unknown or other
  modified_base (308)..(308): a, c, t, g, unknown or other
  modified_base (371)..(371): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagcgtgtcgttttctaggtggctattttaaaaggngtccagtgtgaggtgcaggtgtcggagtctgggggagcttggttcagccgtgggggtccctgagactctcctgtgcagtctctggattaacctttagtgactatgccatgatctgggtccnccaggctccgaggggaagggctgggagtgggtctcgagctaaagttagtggggtagggggtanatttcacccaattacttaacggcaaaggtaccggtccgggtcggggggggacccgtttacacccgacttaccaacccgaaggaacggtaaccaaacctacccgaaggggaactaccaaactaaacccgtaattaaacttaccttaaaccggtaaaaacgtaacgtaaccaacgaacgtaccgtacggaacggtacggtacggtaacgggaaccggtaccgggtaccggttaacggtttaagtttagttacggttacggtacggtaacggttaacggttaaccggttaacccggtaaaccgggtaaccggtaacccgtacccggttacggttacggtttaacgttttcgtttaacg

SEQ ID NO: 393374 - DNA, 781 bp, Homo sapiens
  misc_feature: GZ8MTXP01DW7JS.38.28.C06.1.454.CMB.2.raw
  modified_base (251)..(251): a, c, t, g, unknown or other
  modified_base (274)..(274): a, c, t, g, unknown or other
  modified_base (313)..(313): a, c, t, g, unknown or other
  modified_base (325)..(325): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctggggggaggcttggttcagcctgggggggtccctgagactctcctgtgcagtctctggattaaccttagtgactatgccatgatcgtgggtccgccaggctccgaggggaaggggctggaggtgggtctnagctaattaagtgggtaggggtntatcactatatacgcagcggtcgggtcggggcctcacancacagacacacncgagacacaactaactatactactaaacgaaatcgaacccacgtacgtcgtaggaacgtaaacggtaaccggaacgggaaccgtaaccggggtccgtttaagttaaagtttaggttgggtacgacggaagtaacggtaaccgtaaccccggtaaacgggttacccgtaacccgttacgggtttcgggttcgtttacgttttagttacgttttcggttacgggtacgggggtaaaccggtaaacggggtaacgttaacggttaccggttacccgtaccccgttctttacccgttacccgtaaccggtacccccgtaaccccggaaacccgggtaaccgggtccccttaccggtttccccggttccccgtttcccccggtccgggccccgttccccgttccggtccccgtaccgggaaccggaccgtaccccgttaaccccgtccgggaacgtaaccg

SEQ ID NO: 393375 - DNA, 655 bp, Homo sapiens
  misc_feature: GZ8MTXP01DDPUH.38.28.C06.1.454.CMB.2.raw
  modified_base (323)..(323): a, c, t, g, unknown or other
  modified_base (335)..(335): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtcccctgagactctcctgtgcagtctctggattaacctttagtgactatgccatgatctgggtccgcgaggctccgaggggaaggggctgggagtgggtctcagcaaattaatgggtaggggtgattcacatatacgcagacgtccggtgggggccgttcaccatcaccaganacaactcaggancacactatatctaacaaatgaccacagcctgagaagtcgaaggacacggccgtagtattagtgtagcgagacgactcccgaaacggtcgaaccctaccgtttgggtcgttcttttgtactttccgtaggtcggggaccccgtaaaaggggactaaacgttcggtaccaacccggttcttacccttcgtaccgaccccttacccgaaccgaaaccggggtccccttacgttcccgggttccctttcccccccgggcggttccccgttcccgttcgaacccgtaccgaacgggacctacccgttacccgtccggaagaaccg

SEQ ID NO: 393376 - DNA, 416 bp, Homo sapiens
  misc_feature: GZ8MTXP01BVYXB.38.28.C06.1.454.CMB.2.raw
  modified_base (294)..(294): a, c, t, g, unknown or other
  modified_base (406)..(406): a, c, t, g, unknown or other
  modified_base (411)..(416): a, c, t, g, unknown or other
tcagtcgatcacgtcacgaccggtgctcgatttagagctcacgtattgggtttgggctgagctggctttttcttgtggctattttaaagactccgtgggggccgttcaccatcaccagagacaactccaggagcacactatatctacaaatgcacagcctgagagtcgaggacacggccgtgtattattgtgcgagagatcccaaggtgaccacttggtgtcttttgatttctgtggccaaagggacaatggtcaccgtctcttcagcctccacaaggcccatcggtctccccnggccgcctgctcaggacgcacctccgagagcacagccggccctggggctcgccccctgggtacaaacggtactacttccacgtgactcggactgagcggggctggcaaggcncatannnnnn

SEQ ID NO: 393377 - DNA, 604 bp, Homo sapiens
  misc_feature: GZ8MTXP01EBQUV.38.28.C06.1.454.CMB.2.raw
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggatttaacctttagtgactatgccatgatctgggtccgccaggctccgagggaaggggctgggagtgggtctcagctaattaagtgggtaggggtgattcacatatacgcagactccggtggggggccgttcaccatcaccagagacactcaggncacactatatctaacaaatgaccacagcctgagaagtcgaaggacacgggcctgtatttagtgtgcgagagactcccgaaggtcgaaccctaccgtttggtcgttcttttgatttcgtggttacggggccgtaaagggggaccaagtcggtaccaccgttcttcttcacgtccctccaaccgaaacgggccccttagtcccgggttcccttcccccgtgggccccgccccttcggccctccgaacggtcgcccaccgtcccggaagaaccg

SEQ ID NO: 393378 - DNA, 724 bp, Homo sapiens
  misc_feature: GZ8MTXP01C1HC9.38.28.C06.1.454.CMB.2.raw
  modified_base (215)..(215): a, c, t, g, unknown or other
  modified_base (274)..(274): a, c, t, g, unknown or other
  modified_base (310)..(310): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaaggggctggagtgggtctcagctaattaagtgggtagggggtnatcactatatacgcagcgtcgggtggggcctcacancacagacacactcgaggacncactatatactactaaacaaatcgaccccaacgacgtccgtaggaacggtaaacgggtaccgggaacgggaacccgtacccggggtccgtttagttaactttagttggcgacgtaagacgtaccgtacccggaacggtcgaacccgttacgtttggttcgttcgttttagtacttttcgtcggtacgggggtaaccggtaaaggggtacctaacggttccggtaccctaccgttcttaccgttaccgtaccgtcccctacccgaacccggtaaccgggtccccttacggttccccggttccccgtttcccccggtcgggttccccgttcccgttccggtccccgtacccggaacgggaccctaccccgttacccggtaacccggaacggaaccg

SEQ ID NO: 393379 - DNA, 625 bp, Homo sapiens
  misc_feature: GZ8MTXP01E2GRJ.38.28.C06.1.454.CMB.2.raw
  modified_base (214)..(214): a, c, t, g, unknown or other
  modified_base (272)..(272): a, c, t, g, unknown or other
  modified_base (311)..(311): a, c, t, g, unknown or other
  modified_base (323)..(323): a, c, t, g, unknown or other
  modified_base (328)..(328): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccagggctccgaggggaaggggctggagtgggtctcagcaattaatgggtagggggtnatcactatatacgcagacgtcgggtggggccgtcaccancacagacacacncagancacatatatacaacaatcgaccacacgccgtagacgaagtacggaaggacgacgggtcgtagtatttagtgagacgagacgactaccgaaggtcgaccctacgtttggtgttctttagtatttcgtaggtacggggacgtaaagggactaagtcggtcctaccgttccttcgtcaccgtccctacccgaaccgaaccgggtccccttacggttccccggttccccgttccccggtcgggaccccgttcccgttcgcccgtaccggaacgggaccgacccgacccgtccggaacgccg

SEQ ID NO: 393380 - DNA, 578 bp, Homo sapiens
  misc_feature: GZ8MTXP01EDGWM.38.28.C06.1.454.CMB.2.raw
  modified_base (306)..(306): a, c, t, g, unknown or other
  modified_base (528)..(528): a, c, t, g, unknown or other
  modified_base (561)..(561): a, c, t, g, unknown or other
  modified_base (565)..(565): a, c, t, g, unknown or other
  modified_base (572)..(572): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttgggttcaggcccgggggtcctgagactctcctgtgcagtctctggattaaccttagtgactatgccatgatctgggtccnccaggctccgaggggaaggggctgggagtgggtctcgagcaattaagtgggtaggggtgattcaaccgattaaattacgcgagtaccgtaccgggtcggggggtccggggttaccgacgaactcaacccaacggagacaaacctaccgacggagacacactatatactacaaagtagcacacgcctgagagtacgacgacgacggccgtgtaattattgtgngagagacttcccgaacggtcgaccaactttggngttnttttcgngtttcg

SEQ ID NO: 393381 - DNA, 621 bp, Homo sapiens
  misc_feature: GZ8MTXP01DCWA7.38.28.C06.1.454.CMB.2.raw
  modified_base (374)..(374): a, c, t, g, unknown or other
  modified_base (506)..(506): a, c, t, g, unknown or other
  modified_base (605)..(605): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctgggggggtccctgagactctcctgtgcagtctctggattaaccttagtgactatgccatgatctgggtccgccaggctccgaggggaaggggctgggagtgggtctcagctaattaatgggtaggggtgattcacatattacgcagactccggtggggggccgttcaccatcaccagagacaactccgagagcacactatatctaacaaatcgcacagctgagaacgcgngacacggtccgtagtattagttgtgacgagacggactacccgaaggttcgaaccctacgtttggtcgttcttttaggtatttcgtggttcggggaacccgtaaaggggaacctaaggttcgtcctaccgttntccgtttcacgtccctaccgaaccggaacggccccttagttccggttccccttccccgtcgggccccgttccttacggcccttacccgaacgggacccncccaccgtcgaacgcg

SEQ ID NO: 393382 - DNA, 606 bp, Homo sapiens
  misc_feature: GZ8MTXP01DTCP6.38.28.C06.1.454.CMB.2.raw
  modified_base (334)..(334): a, c, t, g, unknown or other
  modified_base (401)..(401): a, c, t, g, unknown or other
  modified_base (565)..(565): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgagggaaggggctggagtgggtctcagctaattaagtgggtaggggtgattcacatatacgcagactccggtggggggccgttcaccatcaccagagacaactccaggancacactatatctaacaaatgaccacagcctgagaagtcgaagggacacgggccgtgtaattagttgngcgagacgactccccgaaaggtcaacctacgttgggtatcttttgatttctggttcgggaccgtaaaggggacctaaagttcggtaccacccgttcttaccgttcacgcccttacccaaccgaaagggcccccaagttcccggttcccttcccccgtgggcccnccccgttgccctcccgaaggacgccaccgtccgaagaaccg

SEQ ID NO: 393383 - DNA, 546 bp, Homo sapiens
  misc_feature: GZ8MTXP01EX9AI.38.28.C06.1.454.CMB.2.raw
  modified_base (270)..(270): a, c, t, g, unknown or other
  modified_base (317)..(317): a, c, t, g, unknown or other
  modified_base (330)..(330): a, c, t, g, unknown or other
  modified_base (519)..(519): a, c, t, g, unknown or other
  modified_base (526)..(526): a, c, t, g, unknown or other
  modified_base (529)..(529): a, c, t, g, unknown or other
  modified_base (531)..(531): a, c, t, g, unknown or other
  modified_base (545)..(545): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtgggtctcagcaattaatgggtaggggtnattcacatatacgcagactccgtggggggccgtcaccatcaccaganacaactccaggancacactatatctaacaaatgccacagcctgagaagtcgaaggacacgggcctgtattatgtgcgagagactcccaaacggtgaacccacctttggtgtctttgatttctggtggggaccaaaggggacaaagtggtcaccgtctcttcacgcctccaccgaaagggccccagtccggttcttcccccgngccgccngcncncgcgcacctcgcgng

SEQ ID NO: 393384 - DNA, 724 bp, Homo sapiens
  misc_feature: GZ8MTXP01CIEQK.38.28.C06.1.454.CMB.2.raw
  modified_base (275)..(275): a, c, t, g, unknown or other
  modified_base (338)..(338): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtcccctgagactctcctgtgcagtctctggattaacctttagtgactatgccatgatctgggtccgccaggctccgaggggaaggggctgggagtgggtctcagcaaattaagtgggtagggggtntatcactatatacgcagacgtcgggtcgggggtccgtcaccatcacagacacactccgagacncacactatactactaacaaatcgacccacgacgaccgtaggaacggtaaacgggtaccgggaacgggaacccgtaaccggggtccggtttagttaagtttacgtttgggtacggacgaaggaacgtaccgtaaccccggaacgggttcgtaacccgttaccgtttgggtcgttacgttttagtacgtttcgtgggtacggggtaccgaaagggtactaacggttcggtaccgtaccgttccttacgtccgtacgtccctacccgaaccggaaccgggtcccttacggttccccggttcccgttcccccgtcgggttaccccgttcccgttccggtcccgtacccggaacgggacccgacccgttaccccgtaaccggaacggaacg

SEQ ID NO: 393385 - DNA, 699 bp, Homo sapiens
  misc_feature: GZ8MTXP01ECG1J.38.28.C06.1.454.CMB.2.raw
  modified_base (276)..(276): a, c, t, g, unknown or other
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggggtccgccaggctccgaggggaaggggctgggagtgggtctcagactaaattaagtgggtaggggtnattcacatatacgcagacgtcggtgggggccgtcaccatcaccagacacaactccaggancaacactatatactaacaaatcgacccacagcctgaagaacgtcgaaggacaccgggccgttagtaattagtgtgacgaagagactacccgaaacggtcgaaccctaccgttggtcgttcttttagtacttttcgtgggtacggggaacccgtaaagggggtaacctaaaggttcgggttaccctacccggttcttacccgtttccgaccggtacccctaccccgaaacccggtaaacggggtcccccttaacggtttccccgggttccccttcccccccggtgggccccgttccccgttcggtaaccccgttacccggaaacggggtccgaccccttaaccccgtcccgggaacgaacccgg

SEQ ID NO: 393386 - DNA, 606 bp, Homo sapiens
  misc_feature: GZ8MTXP01CY9GS.38.28.C06.1.454.CMB.2.raw
  modified_base (273)..(273): a, c, t, g, unknown or other
  modified_base (585)..(585): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtagggggtnattcacatatacgcagactccggtgggggccgttcaccatcaccagacgacaactccaaggacgcaacactatactctaacaaatcgacccacagcctggagaacgtcgaaggacacgggccgtagtattattgagcgagagactcccgaacggtcgacctaccgtttggtcgtcttttgacttttcgtggtggggacctaaggggaaccagtggtccaccgtctcttcgacgtccctcccaacccgaacgggcccacgttcccggttccttccccccgtgggccccgcccttcgcccgtcccgaaggggcnccgaccctccggaaggaaccg

SEQ ID NO: 393387 - DNA, 627 bp, Homo sapiens
  misc_feature: GZ8MTXP01DDHBX.38.28.C06.1.454.CMB.2.raw
  modified_base (215)..(215): a, c, t, g, unknown or other
  modified_base (273)..(273): a, c, t, g, unknown or other
  modified_base (327)..(327): a, c, t, g, unknown or other
  modified_base (334)..(334): a, c, t, g, unknown or other
  modified_base (402)..(402): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaagggctggagtgggtctcagctaaattaagtgggtaggggtnattcacatatacgcagactccggtgggggccgttcaccatcaccagagacaacnccaggancacactatatacaacaaatcgaccaacagcctagagaagtccgaaggccacgggcttagtattagtgngcgagacgacgtacccgaacgggttcaaccgtaccgtttggtcgttcgttttagacttttcgtggtacggggaacccgtaaaggggacctaaagttcggtaccaccggttcttaccgttcacgtccctacccgaaccgtaacgggccccagttcccggttcccttcccccgtcggcccgccccttggaaccctccggaaggaccgccacccgtccgaaggaaccg

SEQ ID NO: 393388 - DNA, 637 bp, Homo sapiens
  misc_feature: GZ8MTXP01A279D.38.28.C06.1.454.CMB.2.raw
  modified_base (157)..(157): a, c, t, g, unknown or other
  modified_base (180)..(180): a, c, t, g, unknown or other
  modified_base (254)..(254): a, c, t, g, unknown or other
tcagtcgatcacgtcacgaccggtgctcgatttagagctcacgtattgggtttggggaagaggaagactgacggtcctgccacaggtggtgctgggcacggtgggcactcgacacaacatttgcgctcaactgtcttgtccaccttgctgagcgtgngtttctagtggctatttaaaggngtcagtgtgaggtgcaggtgtcggagtctgggggagcttggttcagcctgggggtccgtgagctctcctgtgcngtctctgtattaacttagtgtactatgcatgtagtcgtcggtccgccgacggccgtaccggacggggaacggggacggtggtaggtcggtcgtacgacgacgtaaagttaaggtacgggtaggggtaggtacgttacgtaacctaaacttaacgttaacgtacgtacgtaccggtccgggtcgggggtccgggtaccgtacctactaccgaccgaacgacgaacgaaccgtacgacgacgacacaactaactactactaacgtaactacgacacgacgacgtacgagacgtacgtacgacgaccggtcggtgtagttagttgttggacgaagacgacgttaccgtaacggtacgtaaccgtcgttcggttcgttcgtttgttg

SEQ ID NO: 393389 - DNA, 604 bp, Homo sapiens
  misc_feature: GZ8MTXP01DMMT2.38.28.C06.1.454.CMB.2.raw
  modified_base (372)..(372): a, c, t, g, unknown or other
  modified_base (456)..(456): a, c, t, g, unknown or other
  modified_base (548)..(548): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcttgggttcacggcccggggggtccctggagactctcctgtgcagtctctggattaaccttagtgactatgccatgatcgtggtccgcaggctccgaggggaagggctgggagtgggtctcgagactaaagttagtgggtagggggtnagttcaacctataacgttacgcgagtaccgtcccggggtcggggggtccgttacacgactccacagacgacactccgaaggacncacactatatactaacaaagtcgacaacgagcctaggacgtaggtaaccggaggtaccgacggtccgttggtaattagttggtcgagtaganaccgttcccgaaacgggtcaaccccgtcgttggtgttcttttgttaacgttttcgg

SEQ ID NO: 393390 - DNA, 533 bp, Homo sapiens
  misc_feature: GZ8MTXP01D9I0U.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccagggaanagccacctctcctgcagggccagtcagtagtgtttcaacggctacttagcctggtaccagcaaaactgccaggctccaggctcctcatctatggtacatccgtcagggccacgtggtactcccagacaggttcagtgcaggtgggtctggggacagacttcactctcaccatcagcagactgggagctagaagtatttgctagtgttattactggtacagcaagtatactaacaagtaccgtactacgttttggccgtaagggggaccaagcgtacggaacgaacccgaaagacctggtcggctcgcacctaagttcttcg

SEQ ID NO: 393391 - DNA, 626 bp, Homo sapiens
  misc_feature: GZ8MTXP01EQRCR.38.28.C06.1.454.CMB.2.raw
  modified_base (295)..(295): a, c, t, g, unknown or other
  modified_base (581)..(581): a, c, t, g, unknown or other
  modified_base (592)..(592): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcacatatacgcagactcggngggggccgttcaccatccaccagacgaccaactccaggagcaacactatatactaacaaatgacccaacagccctaggagaacgtcggaacggacgaccgggtccgttaggtattttaagttgacggacgaagacgaccgtacccgaacggtcgaaaccctcgtttggtcgttctttttggtaatttcgtggttcgggggcgtaaacggggactaagtcggttccaccgttcttcttcacgccctaccaccgaacgggcccacgtccggttcccctttcccccggngccccgttccncgtccgccgaacgccgcccgaccgtccgaacgcg

SEQ ID NO: 393392 - DNA, 547 bp, Homo sapiens
  misc_feature: GZ8MTXP01A8M4F.38.28.C06.1.454.CMB.2.raw
  modified_base (370)..(370): a, c, t, g, unknown or other
  modified_base (436)..(436): a, c, t, g, unknown or other
  modified_base (534)..(534): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttgggttcgaggcccggggggtccctgagactctcctgtgcagtctctggattaacctttagtgactatgccatgatctgggtccgccaggctccgaggggaaggggctgggagtggggtctcgagcaattaagtggtacggggtnatcgaccataattacgcagactccgggtgggggccgttcacatcacagagacaactccgagggacncacactatactctaacaaatgcacacgcctgagagtacgaggacacggtcgtgtaattattggtgcgagagacttccccgaaggtcaccaacgttggnttcttttgctttg

SEQ ID NO: 393393 - DNA, 577 bp, Homo sapiens
  misc_feature: GZ8MTXP01C64C0.38.28.C06.1.454.CMB.2.raw
  modified_base (323)..(323): a, c, t, g, unknown or other
  modified_base (336)..(336): a, c, t, g, unknown or other
  modified_base (535)..(535): a, c, t, g, unknown or other
  modified_base (555)..(555): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagcctggggggtccctgagactctcctgtgcagtctctggatttaacctttagtgactatgccatgatctgggtccgccagggctccgaggggaaggggctgggagtggggtctcagctaaattaatgggtaggggtgattcacatatacgcagactcggtgggggccgttcacatcaccaganacaactccaggancacaactatatctaaacaaatcgaccacagccctgaacgagtcgaaggacacgggccgtgtattagtgtgcgagagactcccgaaacggtgaaccctaccgttggtgtcttttgatttcgtggtcggggaccgtaaaggggactaagtggtccaccgttctctcagccctaccacaacggcccagtccgccttccccgngccgccccttagcctcccgnggacgccaccgtccgaagaacg

SEQ ID NO: 393394 - DNA, 676 bp, Homo sapiens
  misc_feature: GZ8MTXP01C2NEG.38.28.C06.1.454.CMB.2.raw
  modified_base (216)..(216): a, c, t, g, unknown or other
  modified_base (277)..(277): a, c, t, g, unknown or other
  modified_base (291)..(291): a, c, t, g, unknown or other
  modified_base (301)..(301): a, c, t, g, unknown or other
  modified_base (323)..(323): a, c, t, g, unknown or other
  modified_base (335)..(335): a, c, t, g, unknown or other
  modified_base (618)..(618): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccnccaggctccgaggggaagggctggagtgggtctcgagactaaagttagtggggtaggggtnattcacatatacgnagacgtcggngggggcctcaccatcaccaganacaactcgaggncacactatatacaaacaaatcgacccacagcctagaagaacgtcgaaggacacgggtccgttagtaattagttgaggacgaagaacgaccgttacccgaaacgggttcgaaccccttaccgtttggtacgttcgttttagaacgttttcgtagggttacgggggaacccgtaaaggggtaacctaaaggttcggtaccctacccgttcttacccgttacgaccgtcccctacccgaaccggaaccgggtccccttacggttccccggttcccctttcccccgnggttccccgttcccttcggccctcccgaaggccgacccaccgtcccggaaggaacccg

SEQ ID NO: 393395 - DNA, 611 bp, Homo sapiens
  misc_feature: GZ8MTXP01D11DC.38.28.C06.1.454.CMB.2.raw
  modified_base (335)..(335): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtgattcacatattacgcagacgtccggtggggggccgttcaccatcaccagagacaactccaggancacactatatctaacaaatgaccacagcctgagaacgtcgaaggacaccgggcctagtacttagtgtgcgagagactaccgaacggtcgaccctaccgttggtgttctttgactttcgtgtacggggaccgaaaggggacctaagtcgtaccgaccgttctcttcacgtccctaccgaaccgaacgggtcccacgttcccggttcccttcccccgtgggccccgttccccgttcgcccgtcccgaacgggaccgcccacccgtccggaacgaaccg

SEQ ID NO: 393396 - DNA, 836 bp, Homo sapiens
  misc_feature: GZ8MTXP01C5YA9.38.28.C06.1.454.CMB.2.raw
tcagtcgatcacgtcacgaccggtgctcgatttagagctcacgtattgggtttggggagctctgagagaggagcccagccctgggattttcaggtcgttttcatttggtgatcaggactgaacagagagaactcaccatggagtttgggctgagctggtctttttcttgtggctaattttaaaaggtgtccagtgtgaggtgcaggtgtcggagtcgtgggggagtcgttggttcgacggtcccggggggtccctgacgactctcctgtgctagtctcgtggtacttaacctttagtgactatcgccatgactcgtcgggtcccgccgaggcctaccggagggggaacggggtcgtggggaggttggggtccacgagacttaaaagtttaaggtacgggggttaagggggttagtactttaccgaaaccctaattaaaccgtttaaccggcgaacgggtaaccccggtttcccgggggttcggggggggtaccccgtttacccgaacccgaacgtaccccgaaaccgaacggaacgaaccgaaacccgttacccgaaacggggacgaccaaacctaaccttaaattaacgttacctaaaacctaaaacgttcggaaacccaaacgacggaccccgtagggaacggtaacgggttaccggaaaccggggaacccgtaaccggggtcccgttaaggttaattttaaggttcggttagggaaccggttaaaggacggttaaacccgttcccccgggttaaaacggggttcccggaaaaccccttccgggttttgggtaccgttttccgttttttaaggttaacgttttttaacccgggg

SEQ ID NO: 393397 - DNA, 632 bp, Homo sapiens
  misc_feature: GZ8MTXP01DWL4N.38.28.C06.1.454.CMB.2.raw
  modified_base (217)..(217): a, c, t, g, unknown or other
  modified_base (271)..(271): a, c, t, g, unknown or other
  modified_base (333)..(333): a, c, t, g, unknown or other
tcagtcgatcacgtcacgaccggtgctcgatttagagctcacgtattgggtttgggctgagcgtggctttttcttgtggctatttttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaagggctggagtgggtctcagcaattaatgggtaggggtnattcacatatacgcagactccggtgggggccgttcaccatcaccagacgacaactccaggancacactatatactaacaaatgaccactagcctgagaagtcgaagggacacgggcctgtattagttggtgacgagagactacccgaaaggttcgaacctaccgtttggtcgtcttttagactttcgtggttcggggacctaaaggggactaaagtcggtaccaccgttctaccttcgacgtccctacccgaaccgaaacgggccccttagttcccgggttccctttcccccccgggtcggccccgttcccgttcgccctaccggaacgggaccgcccgttacccgtccggaacggaaccg

SEQ ID NO: 393398 - DNA, 416 bp, Homo sapiens
  misc_feature: GZ8MTXP01BJW10.38.28.C06.1.454.CMB.2.raw
  modified_base (409)..(416): a, c, t, g, unknown or other
tcagtcgatcacgtcacgaccggtgctcgatttagagctcacgtattgggtttgggctgagctggctttttcttgtggctattttaaaagactccgtgggggccggttcaccatcaccagagacaactccaggagcacactatatctacaaatgcacagcctgagagtcgaggacacggccgtgtattattgtgcgagagatccccaacggtgaccaccttggtgcttttgatttctgtggccaagggacaatggtcaccgtctcttcagcctccaccaaggcccatcggtcttccccctggccgcccctgcctccaggacgcacctccgagagcacagcggccctgggctgcccctggtcaaggctactcccagtgatcgactgagcgggctgggcaaggcgcatagnnnnnnnn

SEQ ID NO: 393399 - DNA, 669 bp, Homo sapiens
  misc_feature: GZ8MTXP01B7OB6.38.28.C06.1.454.CMB.2.raw
  modified_base (306)..(306): a, c, t, g, unknown or other
  modified_base (368)..(368): a, c, t, g, unknown or other
  modified_base (382)..(382): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggctaatttaaaggtgtccagtgtgaggtgcaggtgtcggagtcgtgggggaggcttggttcaggcccgggggtcctgagctctctgtgcagtctctggattaccttagtgactatgccatgactcgtcgggtccnccgaggcctaccggagggggaacgggggctgggtaggtgggtctcgagtactaaagtttagnggggttacggggtntacttacacctaattaacgttaccgcgaaacggtaccggttcccggggttacgggggggccccgtttacgacccgtactacccaacccgaagaaccgtaccaaacgcccgaaagggactaccaaacctagtactaattacaaaccgtaatcgacacacgcgtaggaacgagtacggacgaccgtaccggtacggttataacgttgtttggaaaccggcgaacgtacgaccgttaccgttaccggtaaccgtaccgttccgttcggttcgttcgtttcgtttcgttcg

SEQ ID NO: 393400 - DNA, 569 bp, Homo sapiens
  misc_feature: GZ8MTXP01CTP4K.38.28.C06.1.454.CMB.2.raw
  modified_base (215)..(215): a, c, t, g, unknown or other
  modified_base (465)..(465): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaaangccacctctcctgcagggccagtcagtagtgtttacaacggtctactacgctggtaccagacaaaactgcagctccagctctcatctatgtacatccgtcgacgggccacgtggtactcccgagacctacggttcagtggacgaggttcgggtcgtggggaacagtaaccttcaactctacaccatcagcgagacgtggagtcgtagaagtgtttgctagtgtattacgtgtacagcaagtactactaanaacgtaaccgtacgtacgtttgggaaccgtaagggggaccctaaggcgtaaggacgaaaccgttaaacgaacgtggtacgcgtgaccactaacgttctttaacg

SEQ ID NO: 393401 - DNA, 591 bp, Homo sapiens
  misc_feature: GZ8MTXP01E3R0S.38.28.C06.1.454.CMB.2.raw
  modified_base (260)..(260): a, c, t, g, unknown or other
  modified_base (572)..(572): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccagggctccgaggggaaggggctggagtgggtctcagcaattaangggtaggggtgattcacatattacgcagactccggtggggggccgttcaccatcaccagagacaactccaggagcacactatatctaacaaatgaccacagcctgagaagtcgaaggacacgggccgtgtattagttgtgcgagagactcccgaacggttgaccctacgtttggtagtcttttgactttcgtggttcggggaccaaaggggacaagtcggtccaccgttctcttcacgtccctccaaccgaaacgggccccagtcccggttccttcccccgtggcccgttcccttcggccctccgaaggacnccaccctccggaagaaccg

SEQ ID NO: 393402 - DNA, 692 bp, Homo sapiens
  misc_feature: GZ8MTXP01BV9R7.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctattttaaaaggtgtccagtgtgaggtgcaggtgtcggagtcgtgggggaggcttggttcgacggcccgggggtccctggagactctcctgtgcagtctctggattaaccttagtgactatgccatgtatcggtcggtccgccgcggcctacgggagggggacgggtcggtagggtaggttcgggtctacgacgtagttaaagttagggtaggggttaggggtatacttaccaacctattaaacgtacgaacgtaacggtacccgggtccgggggtccgggggtcccgttaccgaccgtactacccgaacgaaggaacacctaaccgacgaaagggacaccaaccttaataactacgttaactaaacgtaaacggcgaaccgtacgacgtacgaaggacggtacggacggaaccgtccgtacggttcgttagttaagttggttacggacgaggaacgtacgttacccgttaccggttacggtaaccgtaccgttcggttgttctttcgtttgttcgttcgg

SEQ ID NO: 393403 - DNA, 536 bp, Homo sapiens
  misc_feature: GZ8MTXP01B7R03.38.28.C06.1.454.CMB.2.raw
  modified_base (303)..(303): a, c, t, g, unknown or other
  modified_base (348)..(348): a, c, t, g, unknown or other
  modified_base (371)..(371): a, c, t, g, unknown or other
  modified_base (396)..(396): a, c, t, g, unknown or other
  modified_base (417)..(417): a, c, t, g, unknown or other
  modified_base (427)..(427): a, c, t, g, unknown or other
  modified_base (438)..(438): a, c, t, g, unknown or other
tcagtcgatcacgtcacgaccggtgctcgatttagagctcacgtattgggtttgggagctctgagagaggagcccagccctgggattttcaggcgttttcatttggtgatcaggactgaacagagagaactcaccatggagtttgggctgagcgtggctttctagtggctatttaaaaggtgtcagtgtgaggtgcaggtgtcggagtctgggggaggcttgggttcaggcccggggggtccctgagactctcctgtgcagtctctggattaaccttagtgactatgccatgatctgggtccnccaggctccgaggggaagggctgggagtgggtctcagcaattaanggtaggggcatcacataattacnagactccgggtgggggccgttcacntcaccagagaccaatccgagngcacatatanctaacaaagtnacacacgcgacgagagacgacgacgacggcgtgtaagttagttgtgcgagagacgccgacggtaacgaccgtaaccgttcgtcgttcgttcgttgttg

SEQ ID NO: 393404 - DNA, 673 bp, Homo sapiens
  misc_feature: GZ8MTXP01AU68K.38.28.C06.1.454.CMB.2.raw
  modified_base (273)..(273): a, c, t, g, unknown or other
  modified_base (321)..(321): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagctaattaagtgggtaggggtnattcacatatacgcagactccggtgggggccgttcaccatcaccaganacaactccgaggagcacactatatcaacaaatgccacagcctgagaagtcgaaggacacgggcgtgtattagtgtgacgagagactcccgaacggtcgaaccctaccgttggtcgttcttttgacttttcgtggttcgggggaccgtaaaggggtacctaagttcgggtaccctacccggttccttacctttccgaaccggtccccttaccccgaacccggaaaccggggtccccttaacggtttccccggggttcccctttccccccggtcgggggttcccccgttccccgttacgggccccttacccgaacgggggtccccgacccgttaccccggtccggaacgaaccg

SEQ ID NO: 393405 - DNA, 568 bp, Homo sapiens
  misc_feature: GZ8MTXP01EH6AR.38.28.C06.1.454.CMB.2.raw
  modified_base (214)..(214): a, c, t, g, unknown or other
  modified_base (268)..(268): a, c, t, g, unknown or other
  modified_base (328)..(328): a, c, t, g, unknown or other
  modified_base (418)..(418): a, c, t, g, unknown or other
  modified_base (432)..(432): a, c, t, g, unknown or other
  modified_base (519)..(519): a, c, t, g, unknown or other
  modified_base (525)..(525): a, c, t, g, unknown or other
tcagtcgatcacgtcacgaccggtgctcgatttagagctcacgtattgggtttgggctgagctggctttttcttgtggctattttaaaaggtgtccagtgtgaggtgcgggtgtcggagtctgggggaggcttggttcagcctggggggtccctgagactctcctgtgcagtctctggattaacctttagtgactatgccatgatctgggtccnccaggctccagggaagggctggagtgggtctcagcaattaatgggtagggggtnattcaccatatacgcagactcggtgggggccgttcacatcaccagagacaactccaggancacactatatctaacaaatgacacagctgagagtcgaagcacggctagtattagtgtgcgagagactcccgaaggtgaccctacttggtntcttttgatttcgngtcggaccgaagggactaagtcggcctaaccgtctcgttacacgtccctccaccgaagggcccctaagttcccggtcctttccccgnggcccnccccgttggcctcccgaggccgccaccgttccgaagaacgccg

SEQ ID NO: 393406 - DNA, 751 bp, Homo sapiens
  misc_feature: GZ8MTXP01BL6LK.38.28.C06.1.454.CMB.2.raw
  modified_base (214)..(214): a, c, t, g, unknown or other
  modified_base (270)..(270): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccaggggaaggggctggagtgggtctcagcaattaatgggtagggggtnatcacatatacgcagacgtccgggtgggggtccgtacaccatccacgagacgaacaactcgaggacacaacactatactactaaacaaagtcgacccacacgccgtaggaacggaacggtacgggaacggacccgaccggggtccgttagttaatttagttgggtttacggacgaaggaacggtacgtaccccgtaaccgggtaccgtaacccgttacggtttcgggttcgttcgttttagttacgttttcgttcgggttacgggggtaaccggtaaacggggtaaaccgtaacggttaccggttacccgtacccggttcctttaccgttaccgtacccgtaccccgtaacccgaacccggtaaacccgggtacccgttaccggttcccggttccccgttcccccggtccgggccccggttccccgttccgtcccgtacccggaacggaccgacccgttacccgtaaccggaacgtaaccg

SEQ ID NO: 393407 - DNA, 550 bp, Homo sapiens
  misc_feature: GZ8MTXP01AJ98T.38.28.C06.1.454.CMB.2.raw
  modified_base (214)..(214): a, c, t, g, unknown or other
  modified_base (300)..(300): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangccacctctcctgcagggccagtcagtagttgtttcaacggtctacttagcctggtaccagacaaaactgccaggctccagctctnatctatggtacatccgtcagggccacgtggtactccagacacggttcaggtggcaggtgggtctgggacagacttcactctcacatcagcagacgtggaggctagaagtatttgactagttagtattactgtcagctagtatactaacgaagtaccgtactacgtttgggaaccgtaggggaccaaaggcgtagggaacgaaccgaaacgttaacgtggtcggtaacgtcgaccttactcttaacgttcg

SEQ ID NO: 393408 - DNA, 593 bp, Homo sapiens
  misc_feature: GZ8MTXP01BCO6F.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacatagagaactcaccatggagtttgggctgagctggctttttcttgtggctattttaaaaggtgtccagtgtgaggtgcaggtgtcggagtcgtgggggaggcttggttcaggcccggggggtccctgagactctcctgtgcagtctctggtattaaccgttagtgactatgccatgatcgtgggtccgccgaggctccgagggggaagggggctgggagtcgggtctcgagctaaagttaagtgggtacggggtgagttcacctataattacgcgagacgtccgggtgggggtcccgtcacctatccacagacgacaactccgaggacacaacactatactactaacaaatgacacagcctagagacgtcggaggaccgacgggtccgtggttaattagttggtacgcgaggtaacgcttcccgaaacgggtcggaccctaacgtttcgggtgttcgttttgaacttttcg

SEQ ID NO: 393409 - DNA, 558 bp, Homo sapiens
  misc_feature: GZ8MTXP01CCVU8.38.28.C06.1.454.CMB.2.raw
  modified_base (359)..(359): a, c, t, g, unknown or other
tcagtcgatcacgtcacgaccggtgctcgatttagagctcacgtattgggtttgggggaggcttggttcagcctggggggtccccgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctacaaatgcacagcctgagagtcgaggacacggcgtgtattatgtgcgagagatcccaaggtgaccacttggtctcttttgatttcngtggccaagggcaagtggtcaccgtctcttcacgtcctccaccgaacgggcccattccgggtcccttcccccgtgggcccgcccctggacctcccgaggggacgccgaccctccgagcgcacgacgccggtccctgggcctggccctggttcaaacggctacgtccacgttgactcgactgagcgggctgggcaacggg

SEQ ID NO: 393410 - DNA, 653 bp, Homo sapiens
  misc_feature: GZ8MTXP01A927A.38.28.C06.1.454.CMB.2.raw
  modified_base (276)..(276): a, c, t, g, unknown or other
  modified_base (343)..(343): a, c, t, g, unknown or other
  modified_base (413)..(413): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatctgggtccgccaggctccgaggggaaggggctgggagtgggtctcagctaattaagtggggtaggggtnattcaccatattacgcagactccggtggggggccgttcaccatcaaccagacgacaactccaagggnacactaactatatctaacaaagtcgaccacagtcctgagaagcgaaggacacggtctgtattagttcggngacgagacgactaccgaacggtcgaccctacgttggtcgttcgtttagtacgtttcgttggtacggggtacggaacggtaacgtaacgtacgtccgtaccgttccttcttccgtaccgtacccgtacccgaacccgaaccggtacccgttaccgtcccgttcccgttccccgtcccggttcccgttcccgttccgtcccgtacccgaacggaccgacccgacccgtaaccggaacgaacg

SEQ ID NO: 393411 - DNA, 582 bp, Homo sapiens
  misc_feature: GZ8MTXP01DGRGI.38.28.C06.1.454.CMB.2.raw
  modified_base (302)..(302): a, c, t, g, unknown or other
  modified_base (365)..(365): a, c, t, g, unknown or other
tcagtcgatcacgtcacgaccggtgctcgatttagagctcacgtattgggtttgggggaggcttggttcagcctgggggtccctgagactctcctgtgcagtctctggattaacctttagtgactatgccatgatctgggtccgccaggctccagggaaggggctggagtgggtctcagcaattaatggtaggggtgattcaccatattacgcagactccgtgggggccggttcaccatcaccagagacaactccaggagcacactatatctaacaaatgcacagcctgagagtcgaggacncggccgtgtattattgtgcgagagactcccaaacggtgacccacttggtgtcttttgatttcngtggccaaagggcaagtggtcacgtctcttcacgcctcaccaacgggcccactccggttcctccccctggccgccccttgcctccgaagacgccaccgtcgtcgggggccacgacgccggccccttggggccttcggccccttgggttccaaacgggttacttaaccgtttccgaaccgttgacttcggactggacggccgggcttgggcgaacggg

SEQ ID NO: 393412 - DNA, 595 bp, Homo sapiens
  misc_feature: GZ8MTXP01AQK2W.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgtttcaacggctactagcctggtaccagcaaaacctggccaggctcccaggctcctcatctatcggtacatccgtcagggccacgtggtactcccgagacacggttcaggtggcaggtgggtctgggacagacttcactctcacatcagcagacgtgggaggctagaagtatttggactagttagttaatttacgtgttacgagtctaaggtactaaccgtaacaaacgtacccgtaacttacgttttcgggaaccccgtaagggggacccaaaggccgtagggaacgaaacccgaaacggaaaccgtttggacgggtaacctcggaccgacccctaagttccttcccgg

SEQ ID NO: 393413 - DNA, 552 bp, Homo sapiens
  misc_feature: GZ8MTXP01ETU1M.38.28.C06.1.454.CMB.2.raw
  modified_base (209)..(209): a, c, t, g, unknown or other
  modified_base (419)..(419): a, c, t, g, unknown or other
  modified_base (525)..(525): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcacctgtcttgtctcagggaanagccacctctcctgcagggccagtcagtagttgttttacaacggctacttagcctggtaccagacaaaacctggaccaggctccaggctcctcatctatggtacatccgtcagggcctactggtactcccgagactacggtcagtggcaggtgggctgggacagtactcactctcaccatcagcagactgggaagctagaagtatttcgntagtgtattactggtacagactagtaactactaacaacgtaaccgtactacgtttggaacccgtaaggggaccaagcgtacggaagaacccgaaacgaaccgttgnggaactcggacacctaacgttctaacg

SEQ ID NO: 393414 - DNA, 552 bp, Homo sapiens
  misc_feature: GZ8MTXP01BJIPF.38.28.C06.1.454.CMB.2.raw
  modified_base (214)..(214): a, c, t, g, unknown or other
  modified_base (297)..(297): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangccacctctcctgcagggccagtcagagttgtttcaacggctacttagcctggtaccagacaaaactgccagctccagctccncatctatgtacatccgtcagggccactggtactcccagacacggttcagtggcagtgggtctgggacagacttcactctacaccatcagcagactggagctagaagtatttgctagtgtattactgtacagcagtatactaacaagtaccgtactacgtttggaaccgtaagggggaccaaaggccgtagggaacgaaacccgaaaacgaaccgtggtacgggtaacttcggaccaacccgtaagttccctttcg

SEQ ID NO: 393415 - DNA, 685 bp, Homo sapiens
  misc_feature: GZ8MTXP01BGWUP.38.28.C06.1.454.CMB.2.raw
  modified_base (652)..(652): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctgggagtgggtctcagctaaattaagtgggtaggggtgattcaccatatacgcagactccgggtgggggccgttcaccatcaccagacgacaactccgaaggacgcaacacttaatactactaaacaaatgaccccaacagccctaggacggaacgtacggaacgggacaccggggtccgttagttaatttagtgtgacgagacgactacccgaacggtcgaacccgtacgtttggtcggttcttttggtacttttcgtcggtacgggggtaacccgtaaagggggtacctaaggttcgggtaccctacccggttccttccgtttccgaaccgtccccttacccgaaacccggaaccgggtccccttagttccccggttcccctttcccccgtgggccccgttcccgttcgcccnccgaacggaccgccaacccgtccgaacgaaccg

SEQ ID NO: 393416 - DNA, 611 bp, Homo sapiens
  misc_feature: GZ8MTXP01D66LK.38.28.C06.1.454.CMB.2.raw
  modified_base (214)..(214): a, c, t, g, unknown or other
  modified_base (587)..(587): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaaggggctgggagtgggtctcagcaattaagtgggtaggggtgattcaccatatacgcagactccggtgggggccgttcaccatcaccagagacaactccaggacgcacactatatctacaaatcgccacagcctgacgaagtcgaaggacacgggccgttgtattagtgtgcgagagactcccgaaggtcgaaccctaccgtttgggtcgttcgttttgacttttcgtggttacggggaccgtaaggggtacctaacgtggttaccaccgttcctacttccacgtccctaccgacccaacggggccccttaggttcccgttcccgttcccccgtggcccgttcccttcgcctacccgngtccgccacccgtccgaacgaacg

SEQ ID NO: 393417 - DNA, 650 bp, Homo sapiens
  misc_feature: GZ8MTXP01DKYO3.38.28.C06.1.454.CMB.2.raw
  modified_base (319)..(319): a, c, t, g, unknown or other
  modified_base (331)..(331): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaaccttagtgactatgccatgatctgggtccgccaggctccgagggaaggggctggagtgggtctcagcaattaatgggtaggggtgattcacatattacgcagacgtccggtggggggccgttcaccatcaccaganacaactcaggancacactatatctaacaaatcgccacagcctgagagtcgaaggacacggccgtgtattatgtgcgagagactcccgaacggtcgacctaccgtttggtcgtcgttttgacgttttcgtggttcggggacccgtaaaggggtaacctaagttcggtcctacccggtcttccttcgacgtccctacccgaacccgaaacggggtccccacggtttcccgggttcccctttcccccccggtcggggttccccgttccccgttacggtccccttacccggaaccggggcccggacccaaccccgttcccgggaacggaacccgg

SEQ ID NO: 393418 - DNA, 646 bp, Homo sapiens
  misc_feature: GZ8MTXP01CTXOW.38.28.C06.1.454.CMB.2.raw
  modified_base (622)..(622): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctgtggatttaacctttagtgactatgccatgatctgggtccgccaggctccgaggggaaggggctgggagtgggtctcagcaaattaagtgggtaggggtgattcaccatattacgcagacgtccggtggggggccgttcaccatcaccagagacaactccaggacgcacactatatctaacaaatgcccaacagcctgagaagtcgaaggaccacgggtccgttgtattagttgtgcgagagactcccgaacggtcgaacccgtaccgtttgggtcgttcctttttggacttttcgtggttcgggggcgtaaaggggactaaagtcgggtacctacccggttcttccttccgaacgtcccctaccgaacccgaacggggtccccagttcccgggttcccttccccccgtgggttccccgccccgttcgggccctcccggaagggtccncccgaacccgtcccgaagaacccg

SEQ ID NO: 393419 - DNA, 605 bp, Homo sapiens
  misc_feature: GZ8MTXP01CK5AR.38.28.C06.1.454.CMB.2.raw
  modified_base (397)..(397): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaaccttagtgactatgccatgatctgggtccgccaggctccgaggggaaggggctgggagtgggtctcagcaattagtgggtaggggtgattcaccatatacgcagactccggtggggggccgttcaccatcaccagagacaactccaggagcacactatatctacaaatgccacagcctagagaacgtcgaaggacacgggcttgtattagttgngcgagagactcccgaaggttgaccctacgttggtgtcttttgatttcgtggtacggggaccgtaaaggggtcaaagttcgggtcctacccgtcttccttcacggtccctaccgaccgtaaacgggccccttagttcccggttccttcccccgtgggccccgttcccgttcgcctccgaacggcgccgacccgtcccggaagaacccgg

SEQ ID NO: 393420 - DNA, 635 bp, Homo sapiens
  misc_feature: GZ8MTXP01BUSLP.38.28.C06.1.454.CMB.2.raw
  modified_base (369)..(369): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcttggttcgacgtcccggggggtcctggagactctcctgtgcagtctctggattaaccttagtgactatgccatgatcgtggtccgcaggctcgagggagggctgggagtgggtctcagactaaagttaagtgggtacgggggtntagttaccacctattaaacgttaaccgctaaacgggtacccgttcccgggggtcgggggggtcccgttcaacccgtactccaaccgaggacgaccaactccgaagggacacacaactatatactaaacaatacgacaacacgacctaggacgtacgtacggacggtacgaccggtccttaggtaattagttgtacgcgaagcggttaacttcccgaaacgggtctacccgtaacgtttcggtcgttcgttttgttaacgttttcgg

SEQ ID NO: 393421 - DNA, 511 bp, Homo sapiens
  misc_feature: GZ8MTXP01APF9E.38.28.C06.1.454.CMB.2.raw
  modified_base (426)..(426): a, c, t, g, unknown or other
  modified_base (436)..(436): a, c, t, g, unknown or other
  modified_base (481)..(481): a, c, t, g, unknown or other
  modified_base (504)..(504): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccacctctcctgcagggccagtcagagtgttttcaacggctacttagcctggtaccagcaaaacctggccaggctcccaggctcctcatctatggtacatccgtcagggccactggtatcccagacaggttcagtggcagtgggtctgggacagacttcactctcacatcagcagactggagctgagatttgcagtgtattactgtcagnagtatactanaacgtaccgtactacttttggcctaagggggacccaagcgtgganaccgaaacgactgtggctgcacnttcgtcg

SEQ ID NO: 393422 - DNA, 542 bp, Homo sapiens
  misc_feature: GZ8MTXP01BJ0C2.38.28.C06.1.454.CMB.2.raw
  modified_base (358)..(358): a, c, t, g, unknown or other
  modified_base (491)..(491): a, c, t, g, unknown or other
  modified_base (523)..(523): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtctgggggaggcttggttcagcccgggggtccctgagactctcctgtgcagtctctggattaaccttagtgactatgccatgatctgggtccgccaggctccaggggaaggggctgggagtgggtctcagcaattaatggtaggggtnattcaccataattacgcagactccgggtgggggcccgttcacatcaccagagacactccaggagcacactatatactaacaaatcgacacagcctgagagtcgaggacacggccgtgtaattattgtgcgagngacttcccgaaggtcgacccgaacctttgggngttccttttggaattttcg

SEQ ID NO: 393423 - DNA, 560 bp, Homo sapiens
  misc_feature: GZ8MTXP01AJ2G7.38.28.C06.1.454.CMB.2.raw
  modified_base (308)..(308): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcgaggcccgggggtcctgagactctcctgtgcagtctctggattaaccttagtgactatgccatgatcgtgggtcccnccgaggcctccgaggggaggggctgggagtgggctcgagcaattaagtgggtagggtgattcacataacttacgcagacgtccgggtcggggggccgttacaccgatcaccagacgacaactcgaggacgcacactatactactaacaatcgacacacgcctgagacgtacggagaccgacggtccgtgtaattagttggtgcggagagcttcccgaaggtcgacctaacgttggtgttctttgttctttcg

SEQ ID NO: 393424 - DNA, 595 bp, Homo sapiens
  misc_feature: GZ8MTXP01B2T3E.38.28.C06.1.454.CMB.2.raw
  modified_base (437)..(437): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcgttggttcaggcccgggggtccctggagactctcctgtgcagtctctggattaaccttagtgactatgccatgatcgtgggtccgccaggcctccgaggggaaggggctgggagtgggtctgagctaattagtggtagggtgatcgacctataattacgcgagaccgtccgggtgggggccgttcaccactcaccagagacaacgtcaggancacaactatactacaacaaagtgaccaacacgccgtagacggacgtaccggaggtaaccgcggtccgttggtaatttagttggtacgcgtaaggtacaccgttcccgaaacggttcgacccctaacgtttggcgttacttttaagttaacgttttcgg

SEQ ID NO: 393425 - DNA, 589 bp, Homo sapiens
  misc_feature: GZ8MTXP01A1NTK.38.28.C06.1.454.CMB.2.raw
  modified_base (272)..(272): a, c, t, g, unknown or other
  modified_base (442)..(442): a, c, t, g, unknown or other
  modified_base (457)..(457): a, c, t, g, unknown or other
  modified_base (549)..(549): a, c, t, g, unknown or other
  modified_base (555)..(555): a, c, t, g, unknown or other
  modified_base (569)..(569): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtnattcacatattacgcagactccggtgggggccgttcacatcaccagacgacaactccaggacgcaacactatatctaacaaatgaccacagcctgagaaggtcgaaggaccacgggtcgtgttaattattgtgacgagagactcccgaaaggtgaaccctaccgttggtntcgttttgatttcgngtcggggaccgaaaggggtaccaagttcggtccaccgttctaccttcacgtccctaccaccgaacgggccccagtcccggttcctcccccgnggcccncccgttgccctcgnggcgccaccgtccgaagccg

SEQ ID NO: 393426 - DNA, 578 bp, Homo sapiens
  misc_feature: GZ8MTXP01CFEDP.38.28.C06.1.454.CMB.2.raw
  modified_base (285)..(285): a, c, t, g, unknown or other
  modified_base (364)..(364): a, c, t, g, unknown or other
  modified_base (374)..(374): a, c, t, g, unknown or other
  modified_base (473)..(473): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggtctttttcttgtggcttattttaaaaggtgtccagtgtgaggtgcaggtgtcggagtcgtgggggagcttggttcaggcccggggggtcctgagactctcctgtgcagtctctggattaacctttagngactatgccatgatcgtcgggtcccgccgaggcctccgagggggaacggggctgggagtgggtctcagactaattaagngggtagggtnattcacatattaacgcaaggacctcgggtgggggcctcacagtcacagagacactcgagagcaacactatactacaacaaatcggacacgacgtaccgngaacgagtcggaaggcgaacgggcctggttattaattggttgcgagaacgacttacccgaacgggttcaaccctacgttggtcgttctttagtctttcgtaaggg

SEQ ID NO: 393427 - DNA, 577 bp, Homo sapiens
  misc_feature: GZ8MTXP01EVEAP.38.28.C06.1.454.CMB.2.raw
  modified_base (412)..(412): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccagggaaggggctggagtgggtctcagcaattaatgggtaggggtgattcaccatattacgcagactccggtggggggccgttcaccatcaccagagacaactccaggagcacactatatctacaaatgccacagccctgagaagtcgaagacacggccgtgtattatgtgcgagagatcccaagggtnaaccctacctttgggtcgtcttttgattttcgtgttgggggccaaaggggcaagtggtccacgttctcttcacgccctccgaccaaggggtccccagtcccgggttccttcccccgtgggcccgccccttgggcctcccgaaggacgccacctcccgaagaaccg

SEQ ID NO: 393428 - DNA, 687 bp, Homo sapiens
  misc_feature: GZ8MTXP01DWQ86.38.28.C06.1.454.CMB.2.raw
  modified_base (282)..(282): a, c, t, g, unknown or other
  modified_base (296)..(296): a, c, t, g, unknown or other
  modified_base (306)..(306): a, c, t, g, unknown or other
  modified_base (319)..(320): a, c, t, g, unknown or other
  modified_base (332)..(332): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtggggggaggcttggttcagccgtggggggtccctgagactctcctgtgcagtctctggtattaacctttagtgactatgccatgatcgtgggtccgccaggctccgaggggaaggggctgggaggtgggtctcagactaaattaagtggggtaggggtnattcacatatacgnagacgtcggngggggcctcaccnncacagacacacncgaggacacacaactatatactaaacaaatcgacccacgagccctaggaacggaaacgtacggaacgggaacctaaccgggtccgttagttaatttagttggacgacgaagacgtacctacccgaaggtcaaccctcgtttggtcgttctttgactttcgtagggtacggggaaccgtaaaggggactaaggttcggtaccctaccgttcttaccgttcgaccgtcccctacccgaaccggaaacggggtccccttacggttccccggttccccttccccccggtgggttccccgttccccgttgggaacccctacccggaagggacccgtcccaacccgtcccggaaaggcccg

SEQ ID NO: 393429 - DNA, 761 bp, Homo sapiens
  misc_feature: GZ8MTXP01A30Z0.38.28.C06.1.454.CMB.2.raw
  modified_base (322)..(322): a, c, t, g, unknown or other
  modified_base (389)..(389): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagtcgttggttcgacggccccggggggtcctggagactctcctgtgcagtctcgtggtaactttaacctttagtgactatcgccatgatcgtgggtcccncaggctccgaggggaaggcgtggaggtgggtctacgagactaaagttaaggtggggttaacggggtntacgtttccaaacctaagttaaacttaaccggctaaacgggtaacccggttcccgggggttacgggggggggtcccctttaaccgaaccgtaacgttaccccgaaacgacgggaaacggaaccaaacccgttcccgaaacggggacaaccgaacctaaaccttaaattaaccttacgtaaaacctaaaagttcggaacctaacgacgtaccgttaggaacggtacgtaacggaacgggaaccgtacggtccgttaggttaaatttggtttggaggccgaaaggaacgttaaccgttaccccgttaaacggggtaacgtaccccgttaaccggtttggggttgttaccgtttttaagggttaaccttttcggg

SEQ ID NO: 393430 - DNA, 543 bp, Homo sapiens
  misc_feature: GZ8MTXP01DN7VX.38.28.C06.1.454.CMB.2.raw
  modified_base (185)..(185): a, c, t, g, unknown or other
  modified_base (309)..(309): a, c, t, g, unknown or other
  modified_base (334)..(334): a, c, t, g, unknown or other
  modified_base (369)..(369): a, c, t, g, unknown or other
  modified_base (422)..(422): a, c, t, g, unknown or other
  modified_base (433)..(433): a, c, t, g, unknown or other
  modified_base (452)..(452): a, c, t, g, unknown or other
  modified_base (461)..(461): a, c, t, g, unknown or other
  modified_base (498)..(498): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtggctattttaaaaggngtccagtgtgaggtgcaggtgtcggagtcgtgggggaggcttggttcaggcccggggggtccctgagactctcctgtgcagtctgtggattaaccttagtgactatgccatgatcgtgggtccncaggctccgaggggaagggctgggnggtgggtctcgagactaaattaagtgggtaggggntattcacataattacgcagacgtccgggtgggggccgttacacatcacagganacactccaggncacatatatacacaaaganacacacgcngagagacgacggtacgacgtcgtgttaattgttgtgngagagacgttcgacgtaacgtacgtcgttcgtgttcttgttgttg

SEQ ID NO: 393431 - DNA, 637 bp, Homo sapiens
  misc_feature: GZ8MTXP01AOGS6.38.28.C06.1.454.CMB.2.raw
  modified_base (213)..(213): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcacctgtctttgtctccgaggggaanagcccacctctcctgcagggccagtcagagttgtttcaacggctactagcctggtacagacaaaactggcagctccagctctcatctatggtacatccgtcacgggcctacgtcggtactcccgagactacggttccaggtcggcaggtgggtcgtgggacaggacttcacttcacaccatcagcagactggagctgagtatttgactagttagtactttaactgttaccgaagttccgaagttaactaaccttaaacaaacggtacccgttaaacgttaacggtttttccggggaaccggaacggggggttaaacccaaaggttcccggttaaagggggaaccttaaaaccccggaaaacggttaaacccgttgggttaacgggccgttacgggtacccgaaacctctttaacgtttcccggg

SEQ ID NO: 393432 - DNA, 671 bp, Homo sapiens
  misc_feature: GZ8MTXP01BAH9W.38.28.C06.1.454.CMB.2.raw
  modified_base (215)..(215): a, c, t, g, unknown or other
  modified_base (273)..(273): a, c, t, g, unknown or other
  modified_base (597)..(597): a, c, t, g, unknown or other
  modified_base (650)..(650): a, c, t, g, unknown or other
  modified_base (658)..(658): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccnccaggctccgaggggaaggggctggagtgggtctcagcaattaagtgggtagggggtntatcactatactacgacgacggtaccgtccgggtcgggggtcccgttaccaacctactacccaaccgaagaaccgaaccaaccgtaccggaaggacaccaacctaacttaactacttaactaaacgaaatcgaccccacgacgtccgtaggaggtaacggtacgggaacggaaccgaccggggtcgtttagttagtttagtcggtacgacggaagacgaccgtacccggaacggtaccgtaacccgttacgtttggttcgtttcgtttgtactttcgtgggtacggggacgaaagggtactaagtcgtcctccgttctcctacncctcccaccgacgaacggccttcgtcccgttcccgtcccgcgccgccttcgcncgaacgcnccaccgtcgcgcg

SEQ ID NO: 393433 - DNA, 731 bp, Homo sapiens
  misc_feature: GZ8MTXP01AM45U.38.28.C06.1.454.CMB.2.raw
  modified_base (214)..(214): a, c, t, g, unknown or other
  modified_base (273)..(273): a, c, t, g, unknown or other
  modified_base (314)..(314): a, c, t, g, unknown or other
  modified_base (327)..(327): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctgggagtgggtctcagcaattaagtggggtaggggtntatcactatatacgcacgtcgtcgggtggggtcctacacancacgagacacacncgagacacacactatactactaagaatcgacccacgacgtccgtaggaacgtaacggtacgggaacggaccgtaccgggtacgttagttaatttagttcggtacggacgaagacgtaccgtacccggtaacgggtacgtaacccgttacgtttggttcgtttcgttttagtacgtttacgttacggttacgggggtaacggtaaacgggtaacgtaacggttacggttaccgttacccgttaccgttaccgttaccgtaccgtaccccgtaccccgtaacccggtaacccgggtaccccgttaccggttccccggttccccgttcccccggtcccggttccccggttcccgttcccgtcccgtccgaaccggaccgtacccgttacccgtaaccgaaccgaacg

SEQ ID NO: 393434 - DNA, 692 bp, Homo sapiens
  misc_feature: GZ8MTXP01AT5KH.38.28.C06.1.454.CMB.2.raw
  modified_base (215)..(215): a, c, t, g, unknown or other
  modified_base (249)..(249): a, c, t, g, unknown or other
  modified_base (259)..(259): a, c, t, g, unknown or other
  modified_base (270)..(270): a, c, t, g, unknown or other
  modified_base (307)..(307): a, c, t, g, unknown or other
  modified_base (320)..(320): a, c, t, g, unknown or other
  modified_base (327)..(327): a, c, t, g, unknown or other
  modified_base (354)..(354): a, c, t, g, unknown or other
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagctctcctgtgcagtctctggattaacctttagtgactatgccatgatcgtgggtccnccaggctccgaggggaagggctggagtgggtctnagcaattagngggtaggggtntatcactatatacgcagcgtcgggtcgggcctcacancacgagacacacncgagacncacatatactacaacaagtcgaccacncgtcgtaggacgaacggtacggaaggaccgtaccgggtcgttagttagttagtaggtaggacgaagtacggtaccgtacccggaacggtaccgtaccgttacggtttggtacgtttacgtttagtacgtttacgttacggtacggggtaacggtaaacggtaacgtaacgttacggtaccgtacccgttaccgttaccgttaccgtaccgtacccgtacccgtaacccggtaaccggtacccgttaccggttcccggttccccgttccccggtcccggttcccggttcccgttccgtccgtaccgtaaccgaccgaccgaccgtaaccgaacgtaacg

SEQ ID NO: 393435 - DNA, 577 bp, Homo sapiens
  misc_feature: GZ8MTXP01E4AUL.38.28.C06.1.454.CMB.2.raw
  modified_base (215)..(215): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaaanagcccacctctcctgcagggccagtcagagttgttttcaacggtctactagcctggtaccagacaaaacctggaccaggcctcccaggcctcctcatctatggtacatccgtcgacgggccacgtggtactcccgagacgacggttcaggtcggcaggtgggtctgggacagactcactctcacatcagcagacgtggacgcgtagaagtagtttgacgtagtgttattactgtacagactagtaactacgtaacaacgtaccgttaactcgtttggaaccgtaaggggttaccaaggcgtaagggaaccaaccgaaaacgttacgtaaggtcggtaactcggaccactaacgttcttaacg

SEQ ID NO: 393436 - DNA, 619 bp, Homo sapiens
  misc_feature: GZ8MTXP01DQXW1.38.28.C06.1.454.CMB.2.raw
  modified_base (197)..(197): a, c, t, g, unknown or other
  modified_base (249)..(249): a, c, t, g, unknown or other
  modified_base (582)..(582): a, c, t, g, unknown or other
  modified_base (591)..(591): a, c, t, g, unknown or other
  modified_base (608)..(608): a, c, t, g, unknown or other
  modified_base (610)..(619): a, c, t, g, unknown or other
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtgtcgttttctaggtggctaatttaaaagctccgtggggccgttnaccatcaccagagacaactccaggagcacactatatctaacaaaatgcacanctgagagacgaggacgacggcgtgtatatgtgcgagagactaccgaacgtagaccgtaccgttgtgttcgttttgttagtttcgttcgtcggacggaacggtacgtaagtacggtacgtaccgttccccttccttctacgtccctacccgaaacccgaaccgggcccgtaccgttcccggttccccgttcccccgtccggtcccgtccccgtccgtccgtacccgacggaccgaccgacccgtacccgacgacgacgacgacggccggccgtcggccgtcggtcgtcgtacgtaacgtacgtaccgttccgtacgtacgtcgtcgtacgtcgnggcgggcgnggacggacggacgcagngnnnnnnnnnn

SEQ ID NO: 393437 - DNA, 560 bp, Homo sapiens
  misc_feature: GZ8MTXP01CHOST.38.28.C06.1.454.CMB.2.raw
  modified_base (335)..(335): a, c, t, g, unknown or other
  modified_base (346)..(346): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaagggctggagtgggtctcagcaattaatggtaggggtgattcaccatattacgcagactccgtgggggccgttcaccatcaccagagacaactccaggagcacactatatctaacaaatgcacagcctgagagtcgaggacacggccgtgtattatgtgcgagagatcccaaggtnaccacttggtntcttttgatttctgtgcccaaagggacaagtggtcaccgtctcttcagccctccaccgaacgggcccagtccggtccttcccccgtggcccgccctgcctccgaggacgccaccgtccgagacgcacacgtccggcccgtgggctcgccgttggtaccaaggtacctcttcccgacgttgaacttcgaacgtggacggcgggtcgttggaaccg

SEQ ID NO: 393438 - DNA, 615 bp, Homo sapiens
  misc_feature: GZ8MTXP01C4GWT.38.28.C06.1.454.CMB.2.raw
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtagggggtgattcaccatattacgcagactccggtggggggccggttcaccatcaccagagacaactccaggagcacactatatctaacaaatgcacagcctgagaacgtcgaaggacacgggccgtgtattattgtgcgagagactcccaacgggttcgaaccctaccgtttgggtcgtcctttttggatttttcgtcggttagggggacccaaagggggtaaccaaagttcgggtccacccggtttctcctttcacgtcccttacccgaccgaaacgggcccttagtcccggttccttcccccgtgggcccgccccttggccctccgaacgggcgccaccgtccgaaggaacg

SEQ ID NO: 393439 - DNA, 556 bp, Homo sapiens
  misc_feature: GZ8MTXP01EN3G5.38.28.C06.1.454.CMB.2.raw
  modified_base (214)..(214): a, c, t, g, unknown or other
  modified_base (304)..(304): a, c, t, g, unknown or other
  modified_base (412)..(412): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagttgttttcaacggtctacttagcctggtaccagacaaaacctggccaggctccaggctcncatctatggtacatccgtcacgggccacgtggtactcccagacacggttcaggtgcaggtgggctgggacagctcactctcaccatcagcagactgggagctgaagtntttgctagttgtattactgtcagcagtactactaacaagtacccgtaactacgtttcggaaccgaacgggggacccaaaggttccgaggggaacgaaacccgaaacgaacgtggtaggtcctggaccaccgtaagttcttaacg

SEQ ID NO: 393440 - DNA, 574 bp, Homo sapiens
  misc_feature: GZ8MTXP01ANYI0.38.28.C06.1.454.CMB.2.raw
  modified_base (322)..(322): a, c, t, g, unknown or other
  modified_base (390)..(390): a, c, t, g, unknown or other
  modified_base (447)..(447): a, c, t, g, unknown or other
  modified_base (508)..(508): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggtcgttggttccgacggccccggggggtccctgacgactctcctgtgcagtctcgtggtaacttaaccttagtgactatcgccatgatcgtgggtccncgaggcctaccgagggggaagggctgggagtcgggtctacgagactaaagttaagtggggtacgggtnattcactataattacgcagccgtcgggtgggggcctcacactacacagacgacaacncgaagacgacacactatatactaacaatgacacacgctaggagtaggtacgaggacgacgntagtgtattagtgttgacgtgacgcttacccgaaggtccaacgtacgttggttctgttttggtaac

SEQ ID NO: 393441 - DNA, 589 bp, Homo sapiens
  misc_feature: GZ8MTXP01A7BU4.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctcgaggggaaangccacctctcctgcagggccagtcagtagttgttttcaacggtctacttagcctggtaccagacaaaacctggaccaggcctcccaggctcctcatctatcggtacacgtccgtcgacgggccacgtggtactccagactacggttcagtggcaggtgggtcgtggggacaggtaccttcgactctcaccatcagcagacgtgggagtctagaagtatttgactagttagtacttactgtcagactaagtactaactaacgtaacgtaccgtactacgtttcggaaccgaacggggaacctaaggcgtaagggaacgaaacccgttaaacggacgtgggtaggtcctacggacttacccgtaagttccgttaacg

SEQ ID NO: 393442 - DNA, 571 bp, Homo sapiens
  misc_feature: GZ8MTXP01B0MG2.38.28.C06.1.454.CMB.2.raw
  modified_base (316)..(316): a, c, t, g, unknown or other
  modified_base (374)..(374): a, c, t, g, unknown or other
  modified_base (521)..(521): a, c, t, g, unknown or other
  modified_base (553)..(553): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggagcgttgggttcgacggcccggggggtcctggacgactctccgtgtgcagtctcgtggacttaaccttgtgactatgccatgatcgtggtccncaggctccgaggggagggctgggagtgggtctcgagactaaagttagtgggtacgggntagttcacataacttacgcagaccgtcgggcgggggccttacacatcacagacgacactcgaggacacacactatactactaaacaaagtgaccaacacgcctagaacgtagacggacgaccgaacggtccgtagttaattagttgngacgagagccttccgaaggtcacctcgttggnttacctttgaactttcgg

SEQ ID NO: 393443 - DNA, 612 bp, Homo sapiens
  misc_feature: GZ8MTXP01DNKSM.38.28.C06.1.454.CMB.2.raw
  modified_base (216)..(216): a, c, t, g, unknown or other
  modified_base (260)..(260): a, c, t, g, unknown or other
  modified_base (271)..(271): a, c, t, g, unknown or other
  modified_base (398)..(398): a, c, t, g, unknown or other
  modified_base (447)..(447): a, c, t, g, unknown or other
  modified_base (555)..(555): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctgggggggtccctgagactctcctgtgcagtctctggattaacctttagtgactatgccatgatctgggtccnccaggctccgagggaaggggctggagtgggtctcagcaattaangggtaggggtnattcaccatatacgcagactccggtggggggccgttcaccatcaccagagacaactccaggagcacactatatcaacaaatgccacagcctgagaacgtcgaaggacacgggcgttagtattattgncgagagactcccgaaacggtgaccctacgtttggtgtctttgatttcgnggttacggggacgaaaggggactaagtcggtaccacccggttctcgtttcacgtccctaccgaacccgtaaacggggccccttagttcccggttcccctttcccccgngggccccgttcccttcgccctaccgaagggacgcccttaaccgtcccggaagaaccg

SEQ ID NO: 393444 - DNA, 571 bp, Homo sapiens
  misc_feature: GZ8MTXP01CBDEI.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcaacttctcttcctcctgctactctggctcccagattccaccggagagattgtgttgacgcagtctccaggcaccctgtctttgtctccaggggaaagagccaccctctcctgcagggccagtcagagttgtttcaacggctacttagcctggtaccagacaaaacctggccaggctcccaggcctcctcatctatggtacagtccgtcagggcccactggtactcccagacaggttccagtggcaggtggtctgggcagtacttcactctcaccatcagcagacgtggaggctagaagtatttgctagtagtattacgtgtcagctagtatactacgaaagtaccgtactacgttttcggccgtaacggggaccaaggtcgttacgggaacgtaacccgaaaacggacgttcgggtgggaccttcggaccaccgttacttcgttcgtttaaccc

SEQ ID NO: 393445 - DNA, 601 bp, Homo sapiens
  misc_feature: GZ8MTXP01CC4C3.38.28.C06.1.454.CMB.2.raw
  modified_base (310)..(310): a, c, t, g, unknown or other
  modified_base (345)..(345): a, c, t, g, unknown or other
  modified_base (595)..(595): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcgacggcccggggggtccctgagactctcctgtgcagtctctggattaaccttagtgactatgccatgatcgtgggtccnccaggctccgagggggaagggctgggagtgggtcncgagactaaattagtggggtacggggtgtatttcgacctattaaacgttaccgcgacggtaccgtcccggggtacgggggggtcccgttacacccgatccaaccgaagacgaaccaactcccgaagggacgacaacactataactactaaacaatcgacacacgcctgagagtacgaggaccgacggtccgtgtaattagttggtgacggagacgacgttcccgaacgtcgacctcgttgtgttctttgngtttcg

SEQ ID NO: 393446 - DNA, 805 bp, Homo sapiens
  misc_feature: GZ8MTXP01BQAKV.38.28.C06.1.454.CMB.2.raw
  modified_base (309)..(309): a, c, t, g, unknown or other
  modified_base (374)..(374): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttcttgtggctattttaaaaggtgtccagtgtgaggtgcaggtgtcggagtcgtgggggagcttggttcacggcccgggggtcctgagactctcctgtgcagtctcgtggtattaaccttagtgactatgccatgatcgtggtccncgaggctccgaggggagggctggagtgggtctcgagtctaaagttaaggtgggttaacgggggtntaacgtttccaaccgtattaaacgtttaaccgcgtaaacggtacccggttcccgggggttcgggggggtaccccgtttaccgaacccgtagttacccgaaccgaaggaacgaacccgtaaaccgttccccggaaaggggacgacctaaacctaacgttaaacttaacttaacctaaacccgtaaaaatttcggaacccgtaaaccaacgggttacccgtaagggaacggtaacggttaaccccgggaagggtaaacccggtaaccggggtaccccgggttttaagggtttaaactttttaaacggtttgggttacccggaacggttaaggaaacggttaacccgttacccccggttaaacggggttccgtaaccccgttaacccgggttttgggtacggttttcctttttaaggttaacgtttttcccggg

SEQ ID NO: 393447 - DNA, 619 bp, Homo sapiens
  misc_feature: GZ8MTXP01A424P.38.28.C06.1.454.CMB.2.raw
  modified_base (335)..(335): a, c, t, g, unknown or other
  modified_base (562)..(562): a, c, t, g, unknown or other
  modified_base (598)..(598): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcaccatattacgcagactccggtggggggccgttcaccatcaccagagacaactccaggncacactatatctaacaaatgccacagcctgagaagtcgaaggacacgggcgtgtatttatgtgcgagagactcccgaaggtgacccacgtttgggtcgttcttttgtatttcgtggtcgggggtaccgaaaggggtaccaaagttcgggtaccacccggttcttccgttccacggtccctacccgaccgaaacggggccccttagttcccggttccctttcccccgngggcccgttccccgttggccctccgaacgggacccncccgacccgtccgaacgaacg

SEQ ID NO: 393448 - DNA, 557 bp, Homo sapiens
  misc_feature: GZ8MTXP01C9TCP.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangcccaccctctcctgcagggccagtcagtagtgtttcaacggtctactagcctggtaccagacaaaacctggccagcctccaggctcctcatctatcggtacagtccgtcgacgggccacgtggtactcccgagactacggtcaggtggcaggtgggtctgggacagtaccttcgactctacacatcagcagacgtgggagcgtagaagtatttgctagttgtatttacgtgttacagtctaagtactaactaacaacgtaccgtactacgtttcgggaaccgtaggggaccaagcgtaggacgaaccgaaacgacgtggacgcgtacgcgactcttcgttcg

SEQ ID NO: 393449 - DNA, 540 bp, Homo sapiens
  misc_feature: GZ8MTXP01B3L06.38.28.C06.1.454.CMB.2.raw
  modified_base (341)..(341): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (416)..(416): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccacctctcctgcagggccagtcagagtgttttcaacggctacttagcctggtaccagcaaaaacctggccaggctcccaggctcctcatctatggtacatccgtcagggccactggtatcccanacaggttcagtggcagtggggtctgggacaagactcactctcacancanacaganggaggcgtagaagtattgtnagtagtagttaactagtacagacagtaataactaaacaaacgtaaccgtaactacttgtcggtacggacggaacgaacgacgagaacgaaacgaaacgaacgtagtcgcgcactaacttaactg

SEQ ID NO: 393450 - DNA, 674 bp, Homo sapiens
  misc_feature: GZ8MTXP01BB1V4.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcgttggttcgacggcccgggggtcctgagactctcctgtgcagtctcgtggtactttaaccttagtgactatcgaccatgactcgtcgggtccgccgaggccgtacgagggggaggggctgggaggttcgggtctcgagtacgtaaagtttaagtaggggtaggggtgtacttccaaaccctagttaaacttaccgaacgacggtacccggttcccgggggtcggggggtaccccgttcaacccgtacttacccgaaccgtaagaacggaaccaaaccgtccgaacgggaacaccaacctaacttaataactaactaaacaaacgtcgaacaacacgtccaggagacgtacggaacgtacgaccgggtcgtgttaattagttggtgacgtaggaacaccgttccggaacggtctaacccgtccgttgggtcttcgtttgttaacgtttcgg

SEQ ID NO: 393451 - DNA, 697 bp, Homo sapiens
  misc_feature: GZ8MTXP01AULUQ.38.28.C06.1.454.CMB.2.raw
  modified_base (213)..(213): a, c, t, g, unknown or other
  modified_base (273)..(273): a, c, t, g, unknown or other
  modified_base (288)..(288): a, c, t, g, unknown or other
  modified_base (311)..(311): a, c, t, g, unknown or other
  modified_base (323)..(323): a, c, t, g, unknown or other
  modified_base (348)..(348): a, c, t, g, unknown or other
tcagtcgatcacgtcacgaccggtgctcgatttagagctcacgtattgggtttgggctgagcgtgcttttctagtggctattttaaaaggtgtccagtgtgaggtgcaggtgtcggagtctgggggaggcttggttcagcctggggggtccctgagactctcctgtgcagtctctggatttaacctttagtgactatgccatgatctggtccnccaggctccgaggggaagggctgggagtgggtctcagactaaattaagtgggtaggggtnactcactatatacgnagtcgtcgggtgggtcctcacancacagacacacncgagcacacactatactacaacaancgaccacgacgtccgtagaggtaacgtacgggaacggaccgtacgggtcgttagttaagttaggttggtacgacgaagacgtaccgtaaccccggtaacggtaccgtaacccgttacgtttcggtcgtttacgttttagtacgtttacgttacggtacgggggtaacggtaaacgggtaacgtaacgttaccggtaccgtaccgttaccgttaccttaccgtaccgtacccgtacccgaacccgtaaccggtacccgttaccgttcccggttccccgttccccgtccggttcccgttcccgttccgtccgtaccgaacggaccgtaccgacccgtaaccgaacggaacg

SEQ ID NO: 393452 - DNA, 540 bp, Homo sapiens
  misc_feature: GZ8MTXP01A7SRY.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgttttcaacggtctacttagcctggtaccagacaaaacctggccaggctcccaggctcctcatctatggtacatccgtcacgggccacgtggtactcccagacacggttcagtggcaggtgggtctgggacagacttcactctcaccatcagcagacgtgggacggctaggaagtatttacgctagtgttattactgtcagctagtatactaacaagtaccgtactacgtttggaaccgtaggggaccaagcgtaggaacgaaccgaaagacctggtagctgccactcttcgtcg

SEQ ID NO: 393453 - DNA, 633 bp, Homo sapiens
  misc_feature: GZ8MTXP01DELR6.38.28.C06.1.454.CMB.2.raw
  modified_base (287)..(287): a, c, t, g, unknown or other
  modified_base (565)..(565): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctaggtggctaattttaaaaggtgtccagtgtgaggtgcaggtgtcggagtcgtgggggagcttgggttcaggcccgggggtcctgagactctcctgtgcagtctctggtattaaccttagngactatcgccatgatcgtggtccgcaggctccgaggggagggctgggagtgggtctcgagctaaagttaaagtggggtaacggggtatatttacaacctaattaaacgttacgcgaacggtaacgtcccggggtggggggtccccgttacgaaaccactaccaccgaagaacgaaccaaacctacccgaagggacgacaactacctaactatacgtaaacaaagtcgacaacacgtcctagagagtacgaggaaccacggcgtgttaattacgttggngcgagaacgttacttccccgaaaggttcgaacccctcgtttggggttcgtttcgtttgttaacgtttg

SEQ ID NO: 393454 - DNA, 656 bp, Homo sapiens
  misc_feature: GZ8MTXP01AV0UJ.38.28.C06.1.454.CMB.2.raw
tcagtcgatcacgtcacgaccggtgctcgatttagagctcacgtattgggtttgggggaggcttggttcagcctggggggtccccgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctaacaaatgcacagcctgagagtcgaggacacggccgtgtattattggtgcgagagactccccgaacggtcaccctaccgtttggtcgtcttttgtactttcgtggtacgggaccgaaggggacctaaagtcgggtaccctacccggttcttctttaccacgtcccctacccgaaacccgaacggggtccccctagttcccgggttcccctttccccccgtggggcccctccccgttcggccttccccggagggggacgacccgacccgtaccggagacgccacgacggcccggtcccgtgggggcctcgcccgttgggttacgaaacggccttaccgttcacggttgacgtcggactgggacgtcggggactgggccgaaggg

SEQ ID NO: 393455 - DNA, 560 bp, Homo sapiens
  misc_feature: GZ8MTXP01DI86B.38.28.C06.1.454.CMB.2.raw
  modified_base (215)..(215): a, c, t, g, unknown or other
  modified_base (302)..(302): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctccttcctcctgctactctggctcccagattccaccggagagattgtgttgacgcagtctccaggcaccctgtctttgtctccaggggaaangccaccctctcctgcagggccagtcagtagttgtttcaacggctacttagcctggtaccagacaaaactgaccagctcccaggctcncatctatcggtacatccgtcagggccacgtggtactccccagactacggttcagtggcaggtcgggtctggggacagtacttcactctcacatcagcagactggagctagagtatttgactagtagtattctggtcagcagtatacttaacaacgtaccgtaactacgtttgggaaccgtaacgggggaccaaaggttcgtaggaacgaacccgaaaacggaccgtggtacgtctcggacacccgtaattcgttaacg

SEQ ID NO: 393456 - DNA, 646 bp, Homo sapiens
  misc_feature: GZ8MTXP01BAIDY.38.28.C06.1.454.CMB.2.raw
  modified_base (262)..(262): a, c, t, g, unknown or other
  modified_base (500)..(500): a, c, t, g, unknown or other
tcagtcgatcacgtcacgaccggtgctcgatttagagctcacgtattgggtttgggggaggcttggttcagcctggggggtccccgagactctcctgtgcagtctctggattaacctttagtgactatgccatgatctgggtccgccaggctccaggggaaggggctggagtgggtctcagcaattaatggtaggggtgattcaccatattacgcagactccggtgggggccgttcaccatcaccagagacaactccaggancacactatatctaacaaatgacacacgcctagagagtcggaggacacggccgtagtattagttgtgcgagagactacccgaaggtcgaaccctacgtttggtacgtcctttttaggactttttcgaggtacggacccgaagggggtacctaaagttcgggtaccctacccggttctcctttacacgtccctacccgaaccgaaccggggcccctagttcccggttccctttcccccgnggcccgacccctgccgtcccgaggggcgaccaccctcggacgcgaccacgacggcccggtcccgtgggctcggccctgggacaaacggttaccttaccgtccacggttgactcgaccgtggacgggcgggactcgggaacgaacgg

SEQ ID NO: 393457 - DNA, 723 bp, Homo sapiens
  misc_feature: GZ8MTXP01CNLPE.38.28.C06.1.454.CMB.2.raw
  modified_base (278)..(278): a, c, t, g, unknown or other
  modified_base (356)..(356): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtgggtccgccaggctccgagggggaagggctgggagtgggtctcgagactaagttaagtgggtaggggtnattcaccatatacgcagaccgtccgggtggggggcccgttacaccgatccaccgagaacgaccaactccgaagggacnccaacactatactactaaacaaatgacccacagcctaggagaacgtcgaagggaccacgggcgttagttattagttgcgacgaagacgactacccgaaacggtcgaaccttaccggttggttcgttcttttgtacgttttcgtcgggtacgggggacccgaaaggggtacctaaaggttcgggttaccctacccggttctttccgttccgaaccggtccccttacccgaacccggaaaccggggtccccttaacgggttccccgggtttcccccttcccccgggtcgggttccccccgttccccgttaccggtcccgtacccggaaccgggggtcccacccgaccccggttccggaacggaacccgg

SEQ ID NO: 393458 - DNA, 534 bp, Homo sapiens
  misc_feature: GZ8MTXP01BKRBM.38.28.C06.1.454.CMB.2.raw
  modified_base (213)..(213): a, c, t, g, unknown or other
  modified_base (299)..(299): a, c, t, g, unknown or other
  modified_base (388)..(388): a, c, t, g, unknown or other
  modified_base (396)..(396): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaangccacctctcctgcagggccagtcagagtgtttcaacggctacttagcctggtaccagcaaaacctggccaggctcccaggctccncatctatggtacatccgtcagggccactggtactcccagacagattcagtgcaagtgggtctgggacagacttcactctcacatcaacngactggancctagaacgtatttgcgttctatttcgtgtcagcagtatgataccttgtggacgttcgccgaagggaccaagggtgaaagttcgaaaacgttaacgttggttacgggtctggcctaacctattcttcgttctttaacg

SEQ ID NO: 393459 - DNA, 677 bp, Homo sapiens
  misc_feature: GZ8MTXP01EC7IK.38.28.C06.1.454.CMB.2.raw
  modified_base (311)..(311): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcaggcccgggggtcctgagactctcctgtgcagtctctggtattaacctttagtgactatgcctaatgatcgtcgggtccnccgaggctaccggagggggaaggggtctgggtaggtgggtctcgagctaaagttagtgggtaggggtgattcaactataacttacgcacggtaccgttccggggtcggggggtcccgttacaacctacttacccaacgaacggacggaaccaaacctcgaaagggacaccaacactactaactactaaaccaaagtcgaaccaacgacgccgtaggacggtacggtacggaacggtaccgaccgggtccgtaggttaatttacgttagggtcgacgaacgggtaacgttaccgttacccggaaaacgggttccgtaacccgtaacccggtttggggtctttaccgtttttgttaacgttttccggg

SEQ ID NO: 393460 - DNA, 709 bp, Homo sapiens
  misc_feature: GZ8MTXP01BWVGP.38.28.C06.1.454.CMB.2.raw
  modified_base (274)..(274): a, c, t, g, unknown or other
  modified_base (339)..(339): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgaggggaaggggctgggagtgggtctcagctaattaagtgggtaggggtnattcacatatacgcagacgtccgggtgggggccgtcaccatccaacagagaccaactccaaggcncaacactatatactaaacaaatcgacccacagcctaggagtaagccggaaggaccacgggccgttagtaatttagtgtcgacgagacgactcccgaaacggtcgaaccctaccgttggtcgttcttttagtacttttcgtacggtcggggaaccggtaaaggggaacctaaacggttcgggtaccctaaccccggttctttaccccgttccgaacccggttcccctaaccccgaaaccccgggaaacggggtcccccttaacggtttccccgggttaccccgtttccccccggcggttcccccggttaccccgttccggtaaccctcccgaacgggaccgccccacccggttaacccggaacggaacccg

SEQ ID NO: 393461 - DNA, 594 bp, Homo sapiens
  misc_feature: GZ8MTXP01BMGB9.38.28.C06.1.454.CMB.2.raw
  modified_base (548)..(548): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagcaaattaagtgggtagggggtgattcaccatattacgcagactccgtggggggccgttcaccatcaccagagacactccaggagcacactatatctaacaaatgccacagcctgagaagtcgaaggacacgggccgtgtattagttgtgcgagagactcccgaaagggtgaaccctaccttggtcgtcttttgtatttcgtgtcgggggacctaaaggggtaccaaagtcgggttaccacccgttctcttcacgtccctccaccgaacgggccccagtcccggttccttcccccgnggcccgcccttggcctccgaacggacgcccaccgtccgaacgaacg

SEQ ID NO: 393462 - DNA, 593 bp, Homo sapiens
  misc_feature: GZ8MTXP01D812D.38.28.C06.1.454.CMB.2.raw
  modified_base (378)..(378): a, c, t, g, unknown or other
  modified_base (449)..(449): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggtcgttgggttcgaggccccggggggtccctggagactctcctgtgcagtctcgtggtacttaaccttagtgactatcgccatgatcgtggtccgcaggctcgaggggaagggctgggagtgggtctgagactaaagttaagtgggtaggggtntattcacctaataattacgcgagaccgttccgggtggggggccttcacatcacagacgacactcgaaggancacactatactactaacaaatgacaacagcctggacgagtacgaggtaccgacggccgtgtaatttagttgtcgcgtaaggacgacgttaccccgaaggtaacgacccgtaacgtttggtcgttcgttttcgttaagttttcgg

SEQ ID NO: 393463 - DNA, 716 bp, Homo sapiens
  misc_feature: GZ8MTXP01CMUY6.38.28.C06.1.454.CMB.2.raw
  modified_base (334)..(334): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggcattcacatatacgcagactccggtggggggccgttcaccatcaaccagagacaactccaagganacactaactatattaccaaacaaatcgacccaacgaagtccctaggaacgtaacgttacggaacgggaacctaccggggtacccggttagttaaagtttagttggtacgacggaaggaaagaccgttacccgaaaacgggtcgaaaccccttaacccgttttgggtcgttacgttttgtaacgtttccgttagggttacggggaccccgtaaaggggtacctaaaggttcggtaccctacccggttcttaccttccgaacgtcccctacccgaacccgaaacggggtccccttacgttcccggttcccctttcccccgtgggccccgttccccgttcgccctcccgaaggtaccggccttacccgtaacccggaagaacccg

SEQ ID NO: 393464 - DNA, 598 bp, Homo sapiens
  misc_feature: GZ8MTXP01EN61B.38.28.C06.1.454.CMB.2.raw
  modified_base (285)..(285): a, c, t, g, unknown or other
  modified_base (439)..(439): a, c, t, g, unknown or other
  modified_base (474)..(474): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtcgtgggggagcttggttcagccgtggggggtccctgagactctcctgtgcagtctctggtattaaccttagngactatgccatgatcgtgggtccgcgaggctcgagggaagggctggagtgggtctcagcaaagttagtcgggtaggggtgattcgacctaatattcgcagacctcgggtgggggtccgttcaccgatccaaccgaggacacaactccgaggacncactactatactctaacaaatgacacgacgtccgngaacggacgtaccggaggtaaccgaccgggtacccgttaaggttaattagttggttcgacggaagacgacttaccccggaagggttccgaacccgttacgttggttcgttaactttttgtaacg

SEQ ID NO: 393465 - DNA, 738 bp, Homo sapiens
  misc_feature: GZ8MTXP01BISVJ.38.28.C06.1.454.CMB.2.raw
  modified_base (372)..(372): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcgaggcccgggggtcctgagactctcctgtgcagtctctggattaaccgttagtgactatgccatgatcgtggtccgccaggctccgaggggaacgggctgggagtgggtctcgagactaaagttaagtggggtacggggtntatttaccgaaccgtaattaaacgttaccgcgaaggtacccgttcccggggtacgggggggtccccggtttaccaacccgtacgtcccgaaacccgaggaacggaaaccaaaccgttacccgaaaggggaaccgaccaaacctaaccttaaataacttaaccttaaaccaaaaaggttcggaacccaaaccgacggaccccgtaggaaaggtacggtaacgggaacggaacccggtacgggtacccggttagttaaactttaagttgggtacggaccggaaaggtaacggttaaccttcccccggaaagggttccgaaccccgtaaccggtttgggtcgttaccgtttttgttaacgttttccggg

SEQ ID NO: 393466 - DNA, 536 bp, Homo sapiens
  misc_feature: GZ8MTXP01EW1O0.38.28.C06.1.454.CMB.2.raw
  modified_base (286)..(286): a, c, t, g, unknown or other
  modified_base (308)..(308): a, c, t, g, unknown or other
  modified_base (352)..(352): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtcgtgggggaggcttggttcagccgtggggggtccctgagactctcctgtgcagtctctggattaacctttagngactatgccatgatctggtccncaggctccaggggaagggctggagtgggtctcagcaaattaagnggtaggggtgattcaccaatattcgcagactcggtggggggccgttcaccatcaccagagacaactccgaggagcacactatatctaacaaatgcacagcctgagagtcgaggacacggcgtgtattagtgttgcgagagcttacccgaaggtgaaccctaccgttggttactcgtttttgtaa

SEQ ID NO: 393467 - DNA, 617 bp, Homo sapiens
  misc_feature: GZ8MTXP01ETQP2.38.28.C06.1.454.CMB.2.raw
  modified_base (275)..(275): a, c, t, g, unknown or other
  modified_base (422)..(422): a, c, t, g, unknown or other
  modified_base (473)..(473): a, c, t, g, unknown or other
  modified_base (515)..(515): a, c, t, g, unknown or other
  modified_base (595)..(595): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagctaattaagtggggtaggggtnattcaccatatacgcagacgtccgggtgggggcccgttcaccgatcaccagacgacaactccgaggacacaacacttaatatactaaacaaatcgacccacgacgcccgtaagacgtacgaggccacgggtcgtgtaatttgttggngcgagtagactacccgaacggtcacccgttacgttggttacgtcttttagntttacgtgtcggacgaaggggtactaagtcggtacaccgttnttcttcgacgtccctaccaaccgacgggccctacgttccggtcccttccccgtggcccttcccgttgccctccgacggcnccgtacccgccgaacgcgcccg

SEQ ID NO: 393468 - DNA, 553 bp, Homo sapiens
  misc_feature: GZ8MTXP01ED38I.38.28.C06.1.454.CMB.2.raw
  modified_base (180)..(180): a, c, t, g, unknown or other
  modified_base (264)..(264): a, c, t, g, unknown or other
  modified_base (281)..(281): a, c, t, g, unknown or other
  modified_base (288)..(288): a, c, t, g, unknown or other
  modified_base (293)..(293): a, c, t, g, unknown or other
  modified_base (406)..(406): a, c, t, g, unknown or other
  modified_base (422)..(422): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgctttctagtggctatttaaaggngtccagtgtgaggtgcaggtgtcggagtcgtgggggaggcttggttcaggcccggggggtcctgagactctcctgtgcagtctntggattaacctttaggnactatcncatgntcgtggccgcgaggctcggaggggaggtcgtggaggtggtcagagactaaagttaggtgggtacgggtctactcactataatacgcgtagccgtcgggtcggggccgtacacnctcacgagagactacncgagacacactatatatactaacaagtacgacacacgacgagagacgacggacggacgacgtcgtgtaattagttgtgcgagacgacgttccgacgtaacgtacgtaacgtcgtcgttcgtttcgttgttg

SEQ ID NO: 393469 - DNA, 661 bp, Homo sapiens
  misc_feature: GZ8MTXP01DPBJ4.38.28.C06.1.454.CMB.2.raw
  modified_base (198)..(198): a, c, t, g, unknown or other
  modified_base (260)..(260): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcaccatattacgcagactcggtgggggccgttcaccatcaccagagacaactccaggancacactatatctaacaaatgacacagcctgagagtcgagacacggccgtgtattatgtgcgaagagactcccgaaaggtcgaccctaccgtttggtgtctttttggacttttcgtagttcggaacccgaaaggggacctaaagttcgggtaccacccggtttctcttcacgtccctacccgaaccgaacgggcccctaagttcccggttcccttccccccgtgggcccgtccccgtcgcccttaccgggaacggtacgaccacccgtccgaacgagcccaacgacgcccggtcccgtggggcctaacggcccgttgggtaccgaaacgggtaaccttcgttacccgacggttcgaacgttccggtaacgtcgggacggccggggaacgttcggggaaccgg

SEQ ID NO: 393470 - DNA, 601 bp, Homo sapiens
  misc_feature: GZ8MTXP01DBAPD.38.28.C06.1.454.CMB.2.raw
  modified_base (309)..(309): a, c, t, g, unknown or other
  modified_base (345)..(345): a, c, t, g, unknown or other
  modified_base (428)..(428): a, c, t, g, unknown or other
  modified_base (457)..(457): a, c, t, g, unknown or other
  modified_base (469)..(469): a, c, t, g, unknown or other
  modified_base (499)..(499): a, c, t, g, unknown or other
  modified_base (533)..(533): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctaggtggctaattttaaaaggtgtccagtgtgaggtgcaggtgtcggagtcgtgggggagcttggttcaggcccgggggtcctgagactctcctgtgcagtctctggattaacctttagtgactatgccatgatctgggtccnccaggctccgagggggaagggctgggagtgggttcncgagctaattaagtggggtaggggtgtaattcacctataacttacgcgagtaccgtccggggtcggggggcccgttcaaccgntaccaccagacgaacactaccgagggacncaaccattaacnttacaaccaaaagggtcacaacacgaccgngagagacgagacgacgccgtgtaattagttgtgngagagacgttcccgaaccggtaacgtaaccgtaaccgttcggttcggttcgtttcggttttcgtttcg

SEQ ID NO: 393471 - DNA, 606 bp, Homo sapiens
  misc_feature: GZ8MTXP01EYUM5.38.28.C06.1.454.CMB.2.raw
  modified_base (262)..(262): a, c, t, g, unknown or other
  modified_base (281)..(281): a, c, t, g, unknown or other
  modified_base (521)..(521): a, c, t, g, unknown or other
  modified_base (574)..(574): a, c, t, g, unknown or other
  modified_base (599)..(599): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggancacactatatctaacaaangcacagcctgagagtcgaggacacggcctagtattattgtgcgagagactacccgaacggtcgaccctaccgtttggtcgttctttttagacttttcgtagggttaggcccgaaaggggactaaagtcgggtacctaccggttctcttacacgccctacccaaccgaacgggccctacgtccgttcccttcccccgtggcccgccctgcctccggaggacgccacccgtcgagacgcacncgcccgaccgtcgggctcggccttagggtcaaacggtcctaccttccgcgttnaacgtcgcgtgggacggcgggtcgngggaacg

SEQ ID NO: 393472 - DNA, 616 bp, Homo sapiens
  misc_feature: GZ8MTXP01EDPL1.38.28.C06.1.454.CMB.2.raw
  modified_base (217)..(217): a, c, t, g, unknown or other
  modified_base (600)..(600): a, c, t, g, unknown or other
  modified_base (610)..(610): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaaggggaaangcccaccctctcctgcagggccagtcagtagttgtttacaacggtctacgttacgcctggtaaccagaaccaaaaccgtcggaccacggcctcccgaggcctcctcatctagtcggtacacgtccgtcgacgggccacgtggtactacccgagacgtacggttcaggtggcgtaggtcgggtcgtggggactaaggtaccttcaccttcctcacctatcgagacgagtacgtagggacgtacgtaggtaaagttagtttacgacgttaagttacgtttaacgtttaacgtcggtacaaggtactaagttaactaactaaacgtacgtaaccgtacttacgtttcggaacgtaacgggacagcgtaggaacaacgaacgagtgngctgcacgtnttcgtc

SEQ ID NO: 393473 - DNA, 666 bp, Homo sapiens
  misc_feature: GZ8MTXP01ATUK6.38.28.C06.1.454.CMB.2.raw
  modified_base (279)..(279): a, c, t, g, unknown or other
  modified_base (643)..(643): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtcgtggggggaggcttggttcagccgtggggggtccctgagactctcctgtgcagtctctggatttaacctttagtgactatgccatgatcgtgggtccgccaggctccgaggggaaggggctggaggtgggtctcagacaattaagtgggtaggggtnattcaccatatacgcagactccgggtggggggcccttcaccatccaaccaggacgaacaaccgtccgaagggacaccaacaaccttatattacaaacaaatcgacccaacagcctagaggtaagtcggaacgaccgacgggtccgttagtatttagtcgtacgacgaagacgtactacccgaaaggttcgaaccctttacgttggtcgttcttttagacttttcgcgggtacggggacccgtaaaggggaacctaaggtcggtccaccgttcttacctcgaccgttcccaccacccggaacggccccttagtcccggttcccttccccgcgggcccttcccgttgcccctacggaacggacccncccgacccgtaacgaacgaaccg

SEQ ID NO: 393474 - DNA, 556 bp, Homo sapiens
  misc_feature: GZ8MTXP01EJH0Z.38.28.C06.1.454.CMB.2.raw
  modified_base (212)..(212): a, c, t, g, unknown or other
  modified_base (294)..(294): a, c, t, g, unknown or other
  modified_base (342)..(342): a, c, t, g, unknown or other
  modified_base (399)..(399): a, c, t, g, unknown or other
  modified_base (407)..(407): a, c, t, g, unknown or other
  modified_base (413)..(413): a, c, t, g, unknown or other
  modified_base (420)..(420): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccacctgtctttgtctcgagggaancgccacctctctgcagggccagtcagtagttgtttacaacggtctactagctggtacagacaaaacgtgcagctccagctcnatctatgtacatccgtcgacgggccagtgtactccgagactacggttnagtggctaggtgggtcgtgggacagtacttcactcacacatcagcagacgtggacgntagagttntttcgntaagttnttagttacgtgtacagtactaagtaactaacgtaacgtaacgtaccttacgttacgttcggaacggaacgggacaaggacgtaacggaacgaaaccgaaagttacgtggtcgtaactcgaccttactcgttcgtcg

SEQ ID NO: 393475 - DNA, 598 bp, Homo sapiens
  misc_feature: GZ8MTXP01AHQMJ.38.28.C06.1.454.CMB.2.raw
  modified_base (282)..(282): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggcttttcttgtggctattttaaaaggtgtccagtgtgaggtgcaggtgtcggagtcgtgggggagcttggttcagccgtgggggtccctgagactctcctgtgcagtctctggattaaccttagngactatgccatgatctgggtcccgccaggctccgaggggaaggggctggagtgggtctcgagacaaagttaagtcggggtagggggtgtatttccgaaccaaattacttaacgcgaaggaccgttccgggtggggggtccgttcacccgatcaccgtagagacaactccgaggacgacaacactatactactaacaaatgaccaacacgcccgtgagacggtacggaggtaaccgacgggtccgtaagttattagttgttagccgagagcttacccgaacggtcgaaccgtaccgtgggttacttcgtttgtaacg

SEQ ID NO: 393476 - DNA, 628 bp, Homo sapiens
  misc_feature: GZ8MTXP01BFTB2.38.28.C06.1.454.CMB.2.raw
  modified_base (218)..(218): a, c, t, g, unknown or other
  modified_base (251)..(251): a, c, t, g, unknown or other
  modified_base (275)..(275): a, c, t, g, unknown or other
  modified_base (299)..(299): a, c, t, g, unknown or other
  modified_base (311)..(311): a, c, t, g, unknown or other
  modified_base (331)..(331): a, c, t, g, unknown or other
  modified_base (348)..(348): a, c, t, g, unknown or other
  modified_base (350)..(351): a, c, t, g, unknown or other
  modified_base (356)..(356): a, c, t, g, unknown or other
  modified_base (372)..(372): a, c, t, g, unknown or other
tcagtcgatcacgtcacgaccggtgctcgatttagagctcacgtattgggtttgggctgagcgtggcgtttttctgtggctatttttaaaaggtgtccagtgtgaggtgcaggtgtcggagtctgggggaggcttggttcagccgtggggggtccctgagactctcctgtgcagtctctggatttaacctttagtgactatgccatgatctgggtccncaggctccgagggaggggctggagtgggtcctnagactaattaagtgggtaggggtnattcacatatacgcagctccgggngggggcctcacntcacagagacaactcaggancaacatatatcgtaaanannaccanagcgtgagacgacggngacgcgtcgttatatgtgacgagagacgaccgtaccgacggtctaccgttcgttgttcgttctttgtacgttgtcggtacggggtaacgtaacggtactacggttcgtaccgtccgttacttccgtacgtacccgtcccgtaaaccgaccgggtaacccgtcccgttccggttccccgttccccgttccccggcgttccccgttccgttccggtaacctccggaacggtcccgaccgttacccgtcgaacgaaccg

SEQ ID NO: 393477 - DNA, 603 bp, Homo sapiens
  misc_feature: GZ8MTXP01AS1LF.38.28.C06.1.454.CMB.2.raw
  modified_base (285)..(285): a, c, t, g, unknown or other
  modified_base (564)..(564): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgtgctcaactgtcttgtccaccttgctgagctggctttttcttgtggctattttaaaaggtgtccagtgtgaggtgcaggtgtcggagtcgtgggggaggcttggttcagccgtgggggtccctgagactctcctgtgcagtctctggattaacctttagngactatgccatgatcgtgggtcccgccgaggccgtccgagggggaagggggcgttgggaggttgggggtctcgagtacgtaaagtttaaagtcggggtagggggtgtaagtttcaaccgtaaattacttaacgacgacgtacgtcccggggtcggggggtccgttacacccgatcaccgagagaaccacgtaccgaggacgcaacactaatactactaacgaaatgacacagcctagagaggtcgaggacgaccggtcgtgtattgtgttgcgagacgnttacccgaaggtcgaaccgtactggttactcgtttgtcg

SEQ ID NO: 393478 - DNA, 544 bp, Homo sapiens
  misc_feature: GZ8MTXP01AVT7S.38.28.C06.1.454.CMB.2.raw
  modified_base (185)..(185): a, c, t, g, unknown or other
  modified_base (221)..(221): a, c, t, g, unknown or other
  modified_base (228)..(228): a, c, t, g, unknown or other
  modified_base (258)..(258): a, c, t, g, unknown or other
  modified_base (281)..(281): a, c, t, g, unknown or other
  modified_base (283)..(285): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
  modified_base (319)..(319): a, c, t, g, unknown or other
  modified_base (336)..(336): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcggtgtgtttctaggtcggctaatttaaaggngtcagtgtgaggtgcaggtgtggagtgtggggacgnttggtcnggtcccgggggtcctgagctctcctgtgcngtctctggtatacttatgatatncnnntcgtcgcgcgcgcgcgaggaggngngngtgtcgnagatagtagtgtcggtntatcactataatacgcgacgtcgtcggtcggtcgtcacacacacagacgacacgacgacgacgacacactactactactaacaacgtacgacacgacgtacgtacgacgacgtacgacgtacgtacgtcgtagtaagttagttgtgacgtacgaacgacgttacgttacgtaacgtacgtaacgttcgttcgttacgttcgttcgtcg

SEQ ID NO: 393479 - DNA, 597 bp, Homo sapiens
  misc_feature: GZ8MTXP01EOY7A.38.28.C06.1.454.CMB.2.raw
  modified_base (386)..(386): a, c, t, g, unknown or other
  modified_base (460)..(460): a, c, t, g, unknown or other
  modified_base (469)..(469): a, c, t, g, unknown or other
  modified_base (555)..(555): a, c, t, g, unknown or other
  modified_base (584)..(584): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctggtggctaattttaaaaggtgtccagtgtgaggtgcaggtgtcggagtcgtgggggaggcttgggttcgacgggtccccggggggtccctgagactctcctgtgctagtctcgtggtattaaccttagtgactatgccatgatcgtgggtcccgccgaggcctccgagggggaagggctgggaggtgggtctcgagtctaaattaaggtgggtacgggtntacttcaaccattaactacgcgaagtccgtccgggtaggggggcccttacgacctatccaacgagaacacaacncgaaggacncaacactataactactaaacaaacgtcacaacgacgccgtagaaggtacgacggacggtaccacgggtcgtgtaattagttgaggngagagacttccgaggtcgacctcgtggtnttcttgttgttcg

SEQ ID NO: 393480 - DNA, 641 bp, Homo sapiens
  misc_feature: GZ8MTXP01C7LXQ.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttcttgtggctattttaaaaggtgtccagtgtgaggtgcaggtgtcggagtcgtgggggagcttggttcaggcccgggggtccctgagactctcctgtgcagtctctggattaacctttagtgactatgccatgatcgtgggtccgccaggctccgagggggaagggctgggaggtgggtctcgagactaaagttagtggggtaggggtgatttccaacctattaaacttacgcgaaggtaaccgttcccggggtcgggggggtcccgttaccgaacccattacccaacccgaaggacgaacaactcccgaaggacgcaacactaatatactaaacaaagtcgacaacgacgccgtagagaggtacggaaggaccgaacggtccgtggttaattagttggtcgacggaaggagttaaccgttccccgaaacgggtctaacccgtaaccgtttggtcgttctttttgaacgtttttcgg

SEQ ID NO: 393481 - DNA, 658 bp, Homo sapiens
  misc_feature: GZ8MTXP01CEM5J.38.28.C06.1.454.CMB.2.raw
  modified_base (273)..(273): a, c, t, g, unknown or other
  modified_base (296)..(296): a, c, t, g, unknown or other
  modified_base (331)..(331): a, c, t, g, unknown or other
  modified_base (341)..(341): a, c, t, g, unknown or other
  modified_base (402)..(402): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggggtccgccagggctccgaggggaaggggctgggagtgggtctcagcaattaatgggtaggggtnattcacatatacgcagactcggngggggccgtcacatcaccagacgacactccaggancacactatanctaacgaaatgacccacagcctagagaacgtcggaaggaccacgggcctagtatttagtgngcgagagactacccgaagtcgaacctacgttgtcgttcgtttgtaactttcgtggttacggggacgtaaaggggtaacctaaggttcggtaccctacccggttcttaccttacgacccgtacccctcccgaaaccccggtaaacgggccccttaacggttccccggttccccgtttccccccgtcgggccccgttccccgttacggtccccgtacccgaaggaaccggcccttaaccccgtccggaacggaacccg

SEQ ID NO: 393482 - DNA, 696 bp, Homo sapiens
  misc_feature: GZ8MTXP01EZK93.38.28.C06.1.454.CMB.2.raw
  modified_base (355)..(355): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccagggaagggctggagtgggtctcagcaattaatggtagggtgattcaccatattacgcagactccggtgggggccgttcaccatcaccagagacaactccaggagcacactatatctaacaaatgacacagcctgagagtcgaggacacggccgtgtattagttgtgacgagagactcccaaggtcgacctacgttggtnttcttttgactttcgtaggtcggaaccaaaggggacaaagttcggtacctacccgttcttccttcgacgtcccctacccaaaccgaacgggcccctaacgtcccgggtttccccttccccccgtggccccgtccccgtaggtccccttaccggggaacgggtaaccccgacccgtaaccccggacccggaacggaccgaccgtaaccggccgggtccccggtccccggtcggggtacccgtcggtcccggttacgggtaccgaaacggtacccttaaccgttacccggacggttacgaacgtaccgtaacggtcgggacggttcgggtccgttcgggaacg

SEQ ID NO: 393483 - DNA, 618 bp, Homo sapiens
  misc_feature: GZ8MTXP01ACFVM.38.28.C06.1.454.CMB.2.raw
  modified_base (373)..(373): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcgacggcccgggggtcctgagactctcctgtgcagtctctggattaaccgttagtgactatgccatgatcgtgggtccgccaggcctccgaggggagggctgggagtggggtctcgagactaaattagtggggtaagggggtnagtttcaacccattaaacgttcgcgaggacccgttccgggtcggggggtcccgttacaccgatcccgaacaaggagaccaacgtcccgaaggagcacacctataatactaaacaaagtcgacacgacgacctgaagacgtacgaaggaccacgggtcctggttaattagttggtacgcgagaacgacgttacccgaacgggttcgaccctaaccggttggtcgttcgttttaagttcgttttcgg

SEQ ID NO: 393484 - DNA, 605 bp, Homo sapiens
  misc_feature: GZ8MTXP01DC3C6.38.28.C06.1.454.CMB.2.raw
  modified_base (455)..(455): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagcttggttcaggcccgggggtcctgagactctcctgtgcagtctctggtattaaccttagtgactatcgccatgatcgtggtccgcaggctccgaggggaggctggagtgggtctcgagactaaagttagtgggtaggggtgtattcaacctattaaactacgcgaagtaccgtccgggtggggggcccttacgaccgtatcaacccgagaacgacaacgtccgaagggacncaaacactatactactaaacaaatgaccaacacgacctgagacgtacggaggtaccgacggtccgttagtaatttagttgtgacggaagaagacgttcccgaaaggtcgacccgttaacgttggttacgttcttttgttaacgttttcgg

SEQ ID NO: 393485 - DNA, 658 bp, Homo sapiens
  misc_feature: GZ8MTXP01A67DW.38.28.C06.1.454.CMB.2.raw
  modified_base (260)..(260): a, c, t, g, unknown or other
  modified_base (265)..(265): a, c, t, g, unknown or other
  modified_base (308)..(308): a, c, t, g, unknown or other
  modified_base (369)..(369): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcaggcccgggggtcctgagactctcctgtncgggntctctggattaaccttgtgactatgccatgatcgtgggtcccncaggctccgaggggaggggctgggagtgggtctcaggctaaagttaagtgggtacggggtnatttcaccctataattacgctaggaccgtccgggtaggggggtcccgttcaacccgtatccaacccgagaacgaaccaaaccgtcccgaaggggacaccaaccaacttaataacttaccttaaacgaaaatcgaccaacaacggcccttaggacgtacgtacggaacgggtaccaaccgggtccgttaggttaattagtttggggcggacggagtaacgttaccgttaccccggaacgggtaaccgtacccgttaacgtttggttcgtttacgttttgttaacgtttcg

SEQ ID NO: 393486 - DNA, 587 bp, Homo sapiens
  misc_feature: GZ8MTXP01B1MTO.38.28.C06.1.454.CMB.2.raw
  modified_base (364)..(364): a, c, t, g, unknown or other
  modified_base (382)..(382): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctatttaaaggtgtcagtgtgaggtgcaggtgtcggagtctgggggagcttggttcaggcccgggggtcctgagctctcctgtgcagtctcgtggattaaccttagtgactatgccatgatcgtggtccgcaggcctacgagggggaagggtctgggagtgggtctcgagactaagtaagtgggtaccggggtnagttcactataattacgnaagcgtccgggtgggggcccttacaccgatacaccgaagacgacaactccgaagacgacctaaacactaataactactaaacaaggtacgacacgacgacgtacgacgaggtacgacggtacggacggtcgtgttaagttagttgtgacggagacgacgttaccgacgtaacgtaccgtaacgtcgtcgttcgttcgttcgttcg

SEQ ID NO: 393487 - DNA, 685 bp, Homo sapiens
  misc_feature: GZ8MTXP01AQP7G.38.28.C06.1.454.CMB.2.raw
  modified_base (214)..(214): a, c, t, g, unknown or other
  modified_base (259)..(259): a, c, t, g, unknown or other
  modified_base (270)..(270): a, c, t, g, unknown or other
  modified_base (316)..(316): a, c, t, g, unknown or other
  modified_base (327)..(327): a, c, t, g, unknown or other
  modified_base (656)..(656): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcagcaattaagngggtaggggtnattcacatatacgcagactcggtgggggccgttcaccatcacaganacactcaggancacactatatctaacgaaatcgaccctacagccgtagaggaaacgtcgaagggaccgaccggggtccgttgtaactttagtggttcgacgaagacggactacccgaaacgggtcgaacccgtaccgtttgggtacgttccgttttagtacgttttccgtgggttcgggggaacccgtaaagggggacctaaacggttcgggtaccctaacccggttcttaccgtttcaccgggtcccttacccaaccggaacgggtccccttagttccccgggttccccttccccccgtgggttccccgcccgttcggaaccctaccgaacggggaccnccccgttacccgtccggaacggaacccgg

SEQ ID NO: 393488 - DNA, 681 bp, Homo sapiens
  misc_feature: GZ8MTXP01AJ0UD.38.28.C06.1.454.CMB.2.raw
  modified_base (311)..(311): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggcttattttaaaaggtgtccagtgtgaggtgcaggtgtcggagtcgtgggggagcgttggttcgacggcccgggggtcctggagactctcctgtgcagtctcgtggtattaaccttgtgactatgccatgatcgtgggtccnccgaggcctccgaggggaggggcgtgggaggtcgggtctcgaggactaaagttaagtggggtaacggggtgtattccaccgtattaaagttaccgcgacgtaccgtcggggtacgggggtccgttacacgtactccaccgagacgaacacctcgaggacacactacttatactactaacaaagtcgacacacgtcctggaacgtgtaccgggacggtaaccgaccgggtccggttagtttaacgttgtttacgggtcggacccgggtaaagtaacgggttaacccttcccccgggttaaaagggtcccgtaaccccgttaaccggttttcggggtcgttttccggtttttaagttaacgtttttcccggg

SEQ ID NO: 393489 - DNA, 532 bp, Homo sapiens
  misc_feature: GZ8MTXP01EBPJX.38.28.C06.1.454.CMB.2.raw
  modified_base (213)..(213): a, c, t, g, unknown or other
  modified_base (297)..(297): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaanagccacctctcctgcagggccagtcagtagttgtttcaacggtctacttagctggtacagacaaaactgcaggctccagctccncatctatggtacatccgtcagggccactggtactccagacacggttcagtggcaggtgggtctgggacagcttcactctcacatcagcagctggagctagaagtattgctagtgttattacgtgtcagcaagtatactaacaagtaccgtactacgtttggaaccgtaaggggaccaagcgtagggaacgaaccgaaacggaacctggtaggctgacacgtaacgttcgttaacg

SEQ ID NO: 393490 - DNA, 689 bp, Homo sapiens
  misc_feature: GZ8MTXP01AKO3V.38.28.C06.1.454.CMB.2.raw
  modified_base (226)..(226): a, c, t, g, unknown or other
  modified_base (264)..(264): a, c, t, g, unknown or other
  modified_base (283)..(283): a, c, t, g, unknown or other
  modified_base (325)..(325): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccgagggaaggggctgggagtgggtctcagcaattaatgggtagggtgattcaccatattacgcagacgtcggngggggccgttcaccatcaccagagacaactccgaggancacactatatctaacaaangacacagcctgagagtcgagacgacggcgttgtattagttgngcgagagactacccgaaacggtcgaaccctacgtttggtcgttctttttggacttttcgtaagggttcgggaacccgtaaaggggtaaccctaaaggtcgggtaccctacccgtcttccttacgacgtccccttacccgaaccggaaaccgggtccctacgttcccgggtcccctttcccccgagggccccgtacccgttcggccctacccgggaggggacccgacccgtaaccccgacggacgaccgaccgaacggcccggtcccgggcccggtcggggtcctaacgtccggttacggtacgaaacgtaccttaccgttaccgacgttcgaactcgcgtaggcggttcgggcgttcgggaacg

SEQ ID NO: 393491 - DNA, 664 bp, Homo sapiens
  misc_feature: GZ8MTXP01DUXNT.38.28.C06.1.454.CMB.2.raw
  modified_base (261)..(261): a, c, t, g, unknown or other
  modified_base (280)..(280): a, c, t, g, unknown or other
  modified_base (329)..(329): a, c, t, g, unknown or other
  modified_base (344)..(344): a, c, t, g, unknown or other
  modified_base (496)..(496): a, c, t, g, unknown or other
tcagtcgatcacgtcacgaccggtgctcgatttagagctcacgtattgggtttgggggaggcttggttcagcctggggggtccctgagactctcctgtgcagtctctggattaaccctttagtgactatgccatgatctgggtccgccaggctccagggaaggggctggagtgggtctcagcaattaatggtaggggtgattcaccatattacgcagactcggtgggggccgttcaccatcaccagagacaactccaggancacactatatctaacaaangacacagcctgagagtcgaggacacggccgtgtattattggtgcgaganactacccgaacggtnaccctaccgtttggtcgttctttttgacttttcgtaagggttcggcccgaaaaggggacctaaagttcggggtaccctaacccggttctttccttacacgtcccctacccgaaccgtaacggggcccctaagttccggttcccttcccccgnggcccgtacccttgacccgtccggagggccaccacccgtccgaagacgaccgaacgcggcccggcccgttcggggcctcggaccgttgggaccgaaagggtacccttacgttccgaacggttcgaacgttccggaaccgtgggaacgggcggggtccgttgggaaccg

SEQ ID NO: 393492 - DNA, 669 bp, Homo sapiens
  misc_feature: GZ8MTXP01DB8VV.38.28.C06.1.454.CMB.2.raw
  modified_base (283)..(283): a, c, t, g, unknown or other
  modified_base (299)..(299): a, c, t, g, unknown or other
  modified_base (322)..(323): a, c, t, g, unknown or other
  modified_base (341)..(341): a, c, t, g, unknown or other
  modified_base (418)..(418): a, c, t, g, unknown or other
  modified_base (634)..(634): a, c, t, g, unknown or other
  modified_base (647)..(647): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtatttaacctttagtgactatgccatgatcgtgggtccgccgaggctaccggaggggaaggggctgggagtgggtctcagactaaattaagtgggtaggggtntattcactatatacgnagcgtcgggtgggggcctcaccnncacagagacactcgagancaactactatatactaaacaaatcgaccacagcgtagagaacgtacgaacggacacgggtcttagtacttagttcgngacgtaagacgaccgtacccgaaagggtcaacccgttacgtttgggtgtttcgttttagtacttttcggtacggtagggggtaacccgtaaaggggtaactaacgttcggtaccctaccgttcctcttaccgacgtcccctacccaacccggtaacccgggcccaacggtttcccggttccccgtttccccgcggaccccgttcccgcgttaaccnccgaacgggaccnccgacccgtcggaaggaacccg

SEQ ID NO: 393493 - DNA, 648 bp, Homo sapiens
  misc_feature: GZ8MTXP01AR7IN.38.28.C06.1.454.CMB.2.raw
  modified_base (272)..(272): a, c, t, g, unknown or other
  modified_base (636)..(636): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaagggctggagtgggtctcagctaattaagtgggtaggggtnattcacatatacgcagacgtcggtgggggccgttcaccatccaaccagacgaccaactccgaaggacacacaactaatactactaaacaaagtcgacccaacagccctaggaacgtaacggtaccggaagggaccaaccggggtcccgttagttaatttagttggacgacggaagacgtaacgttacccccgaaagggttcgaaaccccgttacgttgggtcgttcttttaggacttttcgtaggtcggggaaccgaaaggggacctaaagttcggtccaccgttctacgttcaacgtccctaccgaaccgaacggccccagttcccggttccttccccggcccgccttagcctcgaaggcccnccacgtcgcgcg

SEQ ID NO: 393494 - DNA, 552 bp, Homo sapiens
  misc_feature: GZ8MTXP01CVHAE.38.28.C06.1.454.CMB.2.raw
  modified_base (299)..(299): a, c, t, g, unknown or other
  modified_base (499)..(499): a, c, t, g, unknown or other
  modified_base (533)..(533): a, c, t, g, unknown or other
tcagtcgatcacgtcacgaccggtgctcgatttagagctcacgtattgggtttggggagctctgagagaggagcccagccctgggattttcaggcgttttcattggtgatcaggactgaacagagagaactcaccatggagtttgggctgagctggcttttctgtggctattttaaaaggtgtccagtgtgaggtgcaggtgtcggagtctgggggagcttggttcagcccgggggtcctgagactctcctgtgcagtctctggattaaccttagtgactatgccatgatctgggtccnccaggctccgaggggaaggggctgggagtgggtctcgagcaaattaagtggtaggggtgattcgaccataattacgcagactccgggtgggggccgttcaccatcaccagacgacaactcccaaggacgcaacactatatctaacaatgcaacagcctgagagtaccgaggacacggccgtgtaattattggtgcgaagngacttcccgaagggttcgaccctaaccgtttggngttacttttggaattttcg

SEQ ID NO: 393495 - DNA, 604 bp, Homo sapiens
  misc_feature: GZ8MTXP01A4393.38.28.C06.1.454.CMB.2.raw
  modified_base (283)..(283): a, c, t, g, unknown or other
  modified_base (371)..(371): a, c, t, g, unknown or other
  modified_base (455)..(455): a, c, t, g, unknown or other
  modified_base (533)..(533): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagcgttggttcaggcccggggggtcctgagactctcctgtgcagtctctggattaacttgngactatgccatgatcgtggtccgccaggcctacgaggggaagggctgggagtgggtctcgagactaaagttaagtgggtaacggggtntattcaccgtataaacttacgcagtaccgtcgggtcggggggcccttacgaccatccaacgagaacgacaacctcgaagggacncaacactatactactaaacaagtcgacaacacgcctgaagagtacggagaccgacggtcctggttaatagtttgacgnggtaagcgaacgttcccgaagggtaacacccgtaaccgttggttcgttaccgttttgttaacgttttccgg

SEQ ID NO: 393496 - DNA, 621 bp, Homo sapiens
  misc_feature: GZ8MTXP01E2NFV.38.28.C06.1.454.CMB.2.raw
  modified_base (271)..(271): a, c, t, g, unknown or other
  modified_base (582)..(582): a, c, t, g, unknown or other
  modified_base (593)..(593): a, c, t, g, unknown or other
  modified_base (601)..(601): a, c, t, g, unknown or other
  modified_base (605)..(605): a, c, t, g, unknown or other
  modified_base (615)..(615): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggagggctggagtgggtctcagctaattaagtgggtaggggtnattcacatattacgcagacgtccgggtgggggccgttcaccatccaccagacgacaactccgaggagcaacactatatactaacaaatcgacccacagccctaggaaggaacgtcggaaggaccgacgggtccgttagtatttagtgtgcgaagagtacgtacccgaacgggtcgaacccctacggtttggtcgttcttttgtacgttttcgtggttacggggacccgaaaggggacctaagtcgggtcctaccgttcttccttccacgccctaccgaccgaacgggcccttagtcccgttccgtccccgnggccgttcccngccctcgnggcnccgacctcgngaaccg

SEQ ID NO: 393497 - DNA, 668 bp, Homo sapiens
  misc_feature: GZ8MTXP01EH7SF.38.28.C06.1.454.CMB.2.raw
  modified_base (272)..(272): a, c, t, g, unknown or other
  modified_base (329)..(329): a, c, t, g, unknown or other
  modified_base (332)..(332): a, c, t, g, unknown or other
  modified_base (463)..(463): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagcaattaagtgggtaggggtnattcacatatacgcagactcggtgggggccgtcacatcaccagacgacactcaggancanactatatactaacaaatgaccacacgcctagagaacgtcgaaggacgacgggtccgtagtatttagtggtagcgagacgactaccccgaaaggtcgaaccctacgtttggtcgttcttttagacttttcgnggttacgggggaccgtaaaagggggtacctaaagttacgggtccctaaccggttcttaccgtttccaacggtccccttacccgaaacccggaaacggggtccccttaacggttcccggggtttccccttcccccggtgggccccggttccccttcgggcccttacccgaaggggaccgacccaacccggtcccggaaggaaccgg

SEQ ID NO: 393498 - DNA, 619 bp, Homo sapiens
  misc_feature: GZ8MTXP01DFRWP.38.28.C06.1.454.CMB.2.raw
  modified_base (330)..(330): a, c, t, g, unknown or other
  modified_base (400)..(400): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagctaattaagtgggtaggggtgattcacatatacgcagctcggtgggggccgtcaccatcaccagagacaactcaggancacactatatctaacaaatcgaccacagcctagagaacgtcgaaggacacgggtccgttgtattagttgngcgagagactacccgaacggtcgaaccgtaccgttggtgtcttttgatttcgtgtcggggaccgtaaaggggacctaagtcggtacctaccgttcttaccgttcacgtcccctaccgaacccgaacgggccccttacgttcccgggttccctttcccccgtgggccccgttcccttcggccctacccgaacggacgcccgacccgtccggaacgaaccg

SEQ ID NO: 393499 - DNA, 595 bp, Homo sapiens
  misc_feature: GZ8MTXP01EF089.38.28.C06.1.454.CMB.2.raw
  modified_base (215)..(215): a, c, t, g, unknown or other
  modified_base (301)..(301): a, c, t, g, unknown or other
  modified_base (303)..(303): a, c, t, g, unknown or other
  modified_base (319)..(319): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccaggggaaangccaccctctcctgcagggccagtcagtagttgttttacaacggtctacttagcctggtaccagacaaaactgcagctccagctcncntctatgtacatccgtnacgggccacgtggtactcccagactacggttcagtggcaggtgggtcgtgggacagtaccttcactctcaccatcagcagacgtagggaggctagaagtagtttgctagttagttagttacgtgttccaagtcgaagtactaacctaacgaacgtaacccgttactacgtttcggaaccgtaacgggggacctaagggttcgtagggaacgttaaacccgaaacggttaacccgtaagggtacggcgttacggaccttaccgtaacgttcttccgg

SEQ ID NO: 393500 - DNA, 586 bp, Homo sapiens
  misc_feature: GZ8MTXP01AM779.38.28.C06.1.454.CMB.2.raw
  modified_base (260)..(260): a, c, t, g, unknown or other
  modified_base (279)..(279): a, c, t, g, unknown or other
  modified_base (440)..(440): a, c, t, g, unknown or other
  modified_base (445)..(445): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactcggtgggggccgttcaccatcaccagagacaactccaggancacactatatctaacaaangacacagcctgagagtcgaggacacggcgtgtattattgtgcgagagactcccgaaaggtcacctaccgttggtgtctttttgatttcgtgtcggccaaagggacaagtcggtcaccgtctcttcagcctccacgaacggcccagtccggtccttccccgnggccnccctgcctccggaggacgccaccgtccgagcgcaacgcgcccggcccgtggggcctcggcccgttgggtaccaaacgggtacctaccgttcccgacgttcgaacgttcggaacgtggacgggccgggtaacgcgggaaccg

SEQ ID NO: 393501 - DNA, 619 bp, Homo sapiens
  misc_feature: GZ8MTXP01EGF80.38.28.C06.1.454.CMB.2.raw
  modified_base (308)..(308): a, c, t, g, unknown or other
  modified_base (466)..(466): a, c, t, g, unknown or other
  modified_base (550)..(550): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagcttggttcaggcccgggggtcctgagactctcctgtgcagtctctggtattaaccttagtgactatcgccatgatcgtggtccncaggctcgaggggaagggctgggagtgggtctcgagcaaattaagtggggtacgggtgtattcaacctattaaacttaacgcgaaaggtacccgttccggggtcggggggtcccgttacacctactccgaaccaaggaacgaacaaactcgaaggganaccaacaactactatactaaacgaaatcgacaacgacgcctaggagagacgacggacacgggtccgtagttaattagttggtgnggaagacgacgttccccgaaggggttccaaccgttaaccgttgggttcttacgtttcgttaacgtttcg

SEQ ID NO: 393502 - DNA, 721 bp, Homo sapiens
  misc_feature: GZ8MTXP01BS0TZ.38.28.C06.1.454.CMB.2.raw
  modified_base (270)..(270): a, c, t, g, unknown or other
  modified_base (332)..(332): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagtgggtaggggtnattcacatattacgcagactccggtgggggccgttcaccatcaccagagacaactccaggancacactatatctaacaaatgaccacagcctgagaagtcgaaggacacgggccgtagtattagttgtgacgagagactccccgaaagggtcgaaccctaccgtttgggtcgttctttttgattttccgtgggttcgggggacccgtaaaagggggtacctaaagttcggggttaccccaaccccggtttccttaccgtttccgaaccggtacccccttaccccgaaaccccggtaaaccgggggtccccccttaaacggtttcccccggggtttccccctttccccccccgggtcggggttccccccgttcccccgttccgggtcccccgttaccccgggaaacggggtcccgtaccccgaaccccggttccccgggaagggaaccccgg

SEQ ID NO: 393503 - DNA, 690 bp, Homo sapiens
  misc_feature: GZ8MTXP01EN9NE.38.28.C06.1.454.CMB.2.raw
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaaattaatgggtaggggtgattcaccatattacgcagactccggtgggggccgttcaccatcaccagagacaactccaggacncacactatatctaacaaatgaccacagcctagagaagtcgaaggacacgggccgttgtactttagtgtgacgagagactacccgaaggtcgaccgtaccgtttgggtcgtcttttagacttttcgtgggttacggggaccgtaaagggggtaacctaaagttcgggttacctaacccggttcttaccgtttccgaacggtccccttacccgaaacccggtaaaacgggggtcccccttaaaggtttccccgggtttccccttccccccgggttcgggccccgttcccccgttcggccccttacccggaacgggtacccggacccttaaccccggttcccgggaacgtaacccgg

SEQ ID NO: 393504 - DNA, 664 bp, Homo sapiens
  misc_feature: GZ8MTXP01DY2V2.38.28.C06.1.454.CMB.2.raw
  modified_base (192)..(192): a, c, t, g, unknown or other
  modified_base (216)..(216): a, c, t, g, unknown or other
  modified_base (234)..(234): a, c, t, g, unknown or other
  modified_base (246)..(246): a, c, t, g, unknown or other
  modified_base (269)..(269): a, c, t, g, unknown or other
  modified_base (607)..(607): a, c, t, g, unknown or other
  modified_base (615)..(615): a, c, t, g, unknown or other
  modified_base (622)..(622): a, c, t, g, unknown or other
  modified_base (641)..(641): a, c, t, g, unknown or other
tcagtcgatcacgtcacgaccggtgctcgatttagagctcacgtattgggtttgggctgagctggctttttcttgtggctattttaaaaggtgtccagtgtgaggtgcgggtgtcggagtctgggggaggcttggttcagccgtggggggtccctgagactctcctgtgcagtctctggattaacctttagngactatgccatgatcgtgggtccncaggctcgagggaagggntggagtggtctnagctaagttaagtggtaggggtnattcaactatatacgcagacgtcgggtgggggccttacaccatccaccagacgaccaactccgaaggacgcaactactaatactactaacaaatcgacaaccgacgctagaacgtaggtaaccgaagggaaccgacgggtccgtttagttaatttagtggtagacgagacgaccgttacccgaaggtcaacccgttacggtttggtagttcctttttagactttcggtacggtacggaccggtaaaggggtaactaaggttcggtaccctaccgttcttacgttaccacgtccccacctaaccggacgggcccctaggttcccggtccccttccccgnggtccccncccgttncccgtaaccggaggtcccncgacccttcggaacgcgaacccg

SEQ ID NO: 393505 - DNA, 711 bp, Homo sapiens
  misc_feature: GZ8MTXP01BJBSI.38.28.C06.1.454.CMB.2.raw
  modified_base (290)..(290): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaacctttagtgactatgccatgatcgtcgggtccgccgaggcctaccggaagggggaaggggcgtgggaggtgggtctcgagactaaagttaagtgggtaggggtnattcacatatacgcagacgtcgggtggggccttcaccatccaacagacgaacactcgaggacacacatatactacaacaaatcgaccacacgcctaggacgaaggtacgaacggacaccgggtccttagttaatttagtgtacggacgaagacgaaccgtaccccgtaaacgggtcgtaaaccccgtttaccgtttggggttacttttacgtttttttaacgtccggttagggtttaccgggaacccggggtaaagggggtaaccttaaaggtccggttaccgtacccgttctaccgttaccgaccgtcccctacccgaacgtaccggccctacgttcccgtacccttccccgtcggcccttcccgttcgttcccgtaaccggacggaaccgccccaccggttaccgaacgccgaacccgg

SEQ ID NO: 393506 - DNA, 758 bp, Homo sapiens
  misc_feature: GZ8MTXP01BEQU0.38.28.C06.1.454.CMB.2.raw
  modified_base (277)..(277): a, c, t, g, unknown or other
  modified_base (344)..(344): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtgggtccgccaggcgtccgaggggaaggggctgggagtgggtctcagctaagttaagtgggtaggggtnattcactatatacgcagacgtccgggtgggggccgttcaccatcaccagacgacaacctcgaggacncacactatatactaacaaatcgaccacagcctaggacgaacggtccggaagggaccgaaccggggtccgtttagttaacgtttagttgggtacggacgggaagtaacggtaaccttaccccggtaaacgggttcggaaaccccgttaccggttttaggggttcgtttacgtttttacgtaacgtttttccggtagggttacggggggtaacccgtaaagggggtaacctaaacggttccggttaccctaccccggttcttcccgttccgaaccgtccccgtacccgaacccggaaaccggggtcccccttacggttccccgggttccccttcccccggtcgggttccccgttccccgttcggccccgtacccggaacgggtaccgacccgttaccccggtccggaacggcccgg

SEQ ID NO: 393507 - DNA, 643 bp, Homo sapiens
  misc_feature: GZ8MTXP01DNTHS.38.28.C06.1.454.CMB.2.raw
  modified_base (187)..(187): a, c, t, g, unknown or other
  modified_base (224)..(224): a, c, t, g, unknown or other
  modified_base (251)..(251): a, c, t, g, unknown or other
  modified_base (264)..(264): a, c, t, g, unknown or other
  modified_base (410)..(410): a, c, t, g, unknown or other
  modified_base (568)..(568): a, c, t, g, unknown or other
tcagtcgatcacgtcacgaccggtgctcgatttagagctcacgtattgggtttggggagctctgagagaggagcccagccctgggattttcaggcgtttttcatttggtgatcaggactgaacagagagaactcaccatggagtttgggctgagcgtggtctttttctgtggctattttaaaaggtntcagtgtgaggtgcaggtgtcggagtcgtaggggggngtcgttggtcgacgggcccggggtccngacgctctcgtgngctagtcctgtggttaactttaaccgtttgtagactagtcgactagtagtcgtcggtccggtcccgaccgaggtccctacggggaagggggacgggtcgtgggtacggtcgggtcctagacgattaaagttaggtggggttaggtntactacactataaacttacgcgaacgtcccggtccgggggtcggggtacccgtacaccagtaccaagaagacaacgacctacgaggactacaactatactactaacaaactaagcgacacgacgacgagacgacggacgaacggtccgtacgttagtntttaagtagttggacgaagacgtcgttacccgttcgaacggtctaccgttgttcgttctttgtttaagttcgttg

SEQ ID NO: 393508 - DNA, 634 bp, Homo sapiens
  misc_feature: GZ8MTXP01EUPCH.38.28.C06.1.454.CMB.2.raw
  modified_base (219)..(219): a, c, t, g, unknown or other
  modified_base (262)..(262): a, c, t, g, unknown or other
  modified_base (271)..(271): a, c, t, g, unknown or other
  modified_base (384)..(384): a, c, t, g, unknown or other
  modified_base (614)..(614): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccgaggggaaggggctggagtgggtctcagcaattaagtgggtaggggtgattcaccatattacgnagactccggtgggggccgttcaccatcacagagacactcgagncacactatntctaacaaatgcacagcctgagagtcgaggacacggcgtagttattagttgtgcgagagtacctcccgaacggtcgaccctacgtttggtagttctttttaggtacttttcgngggttacgggccgaaaggggtacctaagtcgggttaccctaccgttctttccttccacgtccctaccgaccgacggccctacgttcccgttccctccccgtggcccgtccctcgccctacggacggtaccgcctacccgtccggagaccggccaaccgtcggcccggcccgtggggcctaaccggtccgttagggaccaaacggtcttaccgttcgcgttgaactaccgngtggcggcggtcgcggaacg

SEQ ID NO: 393509 - DNA, 714 bp, Homo sapiens
  misc_feature: GZ8MTXP01D4OLX.38.28.C06.1.454.CMB.2.raw
  modified_base (215)..(215): a, c, t, g, unknown or other
  modified_base (273)..(273): a, c, t, g, unknown or other
  modified_base (287)..(287): a, c, t, g, unknown or other
  modified_base (310)..(310): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgaggggaagggctggagtgggtctcagctaaattaagtgggtaggggtnattcacatatacgnagactcgggtggggccgtcacgntcaccagagacaactcagancacactatatactaacaaatcgaccacagccgtagagaacgtacgaacgggacacgggtcctggttaattagttggtcgacggaaggacgtaacgtaccccgtaaacggggtacgtaaccccgttaaccgttttggggttacggttcctttttagggtaactttttaccgttgggttacggggggtaacccgtaaaagggggttaaaccaaaggtttccggggtacctaacccgtttcgttcccttttacgaccggttaccccttacccgaaaccccggtaaacggggtccccttacgttcccgggtttccccttcccccgttcgggcccgttacccttcgcccttacccgaaggacccgacgttaaccctccgaacgaaccgg

SEQ ID NO: 393510 - DNA, 681 bp, Homo sapiens
  misc_feature: GZ8MTXP01C7N9J.38.28.C06.1.454.CMB.2.raw
  modified_base (278)..(278): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatatacgcagactcggtgggggccgttcaccatcaccagagacaactccaggagcacactatatctaacaaangcacagcctgagagtcgaggacacggccgtgtattattggtgcgaagagacttaccccgaaacggtcgacctaccgtttgggtcgttctttttgattttccgtagggttcgggtcccgaaaggggacctaaagttcggggtacctacccgttctacctttaccacgtcccctacccgaacccgaaacggggtccccctaagttccccgggttccctttccccccggtgggccccgcccccgtggtacccctcccggagggaccgccctaaccccgtccggaacgacgaccctaacgacgcccgggccctgggggccttcggcccgttgggtaccaaagggtaccttaccgttcccgaacgttgtaacgtcgtaaccgtgggacggcgggtcgttggggaaccg

SEQ ID NO: 393511 - DNA, 697 bp, Homo sapiens
  misc_feature: GZ8MTXP01ALJOA.38.28.C06.1.454.CMB.2.raw
  modified_base (317)..(317): a, c, t, g, unknown or other
  modified_base (385)..(385): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcttggttcgacggcccggggggtcctgagactctcctgtgcagtctcgtggtactttaaccttagtgactatcgccatgatcgtcgggtcccnccgaggcctcggagggggaggggctgggaggtgggtctcgaagtaactaagtaggtaggggtacggtntactacgactagtaacgtcgcgacgtcccgggtcgggggtccggggtcctacgacgtacaccgacgacgaacaccgtaccacggaacggtcaactaactaattactaactactaaaagacggtacgaccacgacccgttagaacggaacggttaccgaacggggtacggtaacccggtacggttaccggtttaattaagtttaacggttggacggttacggaaacgtaccggttaacccgttaaccgggggacgtaaccctccggtttaacgggtttcggttcgttttacgttaagttttcccggtaagggg

SEQ ID NO: 393512 - DNA, 583 bp, Homo sapiens
  misc_feature: GZ8MTXP01EFW5I.38.28.C06.1.454.CMB.2.raw
  modified_base (214)..(214): a, c, t, g, unknown or other
  modified_base (333)..(333): a, c, t, g, unknown or other
  modified_base (541)..(541): a, c, t, g, unknown or other
  modified_base (569)..(569): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctggagtgggtctcagcaattaagtgggtaggggtgattcacatatacgcagactccggtggggggccgttcaccatcaaccagagacaactcaggancaacactatatctaacaaatgccacagcctgagaagtcgaagggacacgggctgtattatgtgcgagacgactacccgaaggtcgaaccctacgttggtcgtactttgatttcgtggtcggggaccgaaaggggtacaagtcggtacctaccgttctcgttcacgtccctaccgacgaacgggcccagttcccggttccttcccccgnggcccgcccttcgcctcccgaaggaccnccaccgtcgaagcg

SEQ ID NO: 393513 - DNA, 604 bp, Homo sapiens
  misc_feature: GZ8MTXP01B8KGL.38.28.C06.1.454.CMB.2.raw
  modified_base (217)..(217): a, c, t, g, unknown or other
  modified_base (303)..(303): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaaggggaaanacgcccaccctctcctgcagggccagtcagtagttgtttcaacggtctactagcctggtacagacaaaactgcagctccagctccnatctatggtacatccgtcgacgggccacgtggtactacccgagaacgtacggttcaggttggccgtaggtcgggtcgtggggactaggtaccttcaaccgttctaccacctatcgaagccaagacgtggggagtacgtaggtaaacgttattttcgatagttagttaactttacgtggtacctagcgtaagttaactaacgtaaacgaacgtaacccgtacttacgtttcggaacccggtaagggaccaaagcggtaaggacaacccgaaagacgtgtaggctgcactaagttcgttaacg

SEQ ID NO: 393514 - DNA, 736 bp, Homo sapiens
  misc_feature: GZ8MTXP01DV22I.38.28.C06.1.454.CMB.2.raw
  modified_base (272)..(272): a, c, t, g, unknown or other
  modified_base (335)..(335): a, c, t, g, unknown or other
  modified_base (663)..(663): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctcgggtccgccaggctccgagggaagggctggagtgggtctcgagctaattaagtgggtaggggtnattcacatatacgcagacgtccggtgggggccgttcaccatcaccagagacaactccaggacncaacactaatatactaacgaaatcgacccaacgagcccgtagaacggaacggttacgggaacggggacctaaaccggggtcccgttagttaagtttagtttgggtacggacggaagtaacgtactaccccggaaaggttcggaaccctaccgtttgggtcgttcttttagtactttcgtcggtacgggggaacccgtaaaggggtaacctaaaggttcggtaccctacccggtttctttacccgttaccgaaccggtcccccttaacccgaaacccgggtaaaccggggcccccttaaaggttccccggttccccgtttccccccggngggttcccccgttccccgttacgcccgtacccggaacgggacgaccccgttacccggtcccgaaggtaacccg

SEQ ID NO: 393515 - DNA, 697 bp, Homo sapiens
  misc_feature: GZ8MTXP01E3X7M.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaatttaaaaggtgtccagtgtgaggtgcaggtgtcggagtcgtgggggaggtcgttggtcgacggcccgggggtccctggagactctcctgtgctagtctcgtaggtacttaaccttgtgactatcgacctatgactcggtcgggtcccgccgaggccgtccggaagggggacggggtcgtagggtaggtcgggtctacgagtactaaagttaaggtggggtacggggtatatacaactagtaaacttacgcgacgggtaccggtccggggtaccggggggtcccgttacgacctacgtaccaaccgaaggaacgaaccaaccgtcgaacggtacgaccaactaactacttaactaactaaactaaagtcgaaccaacgacgtaccgtagaacggacggtacggacggaaccgtacggtccgttagttaattagttggtcgacggtaaacgacgttaccgttaccccgaacgggtccctaccgtaaccgtttggtcgtttacgtttaacgttaagtttccggg

SEQ ID NO: 393516 - DNA, 703 bp, Homo sapiens
  misc_feature: GZ8MTXP01A829Y.38.28.C06.1.454.CMB.2.raw
  modified_base (280)..(280): a, c, t, g, unknown or other
  modified_base (315)..(315): a, c, t, g, unknown or other
  modified_base (340)..(340): a, c, t, g, unknown or other
  modified_base (664)..(664): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtatttaacctttagtgactatgccatgatcgtggtccgccaggctccgaggggaagggctgggagtgggtctcgagactaaagttaagtgggtaggggtnatcacatatacgcagcgtcgggtggggcctcaccntccacgagacacaactcgaaggacncaactacttatatactaaacgaaatcgacccacacgccgtagaggaaacgtacggaaggaccgtaccgggtaccgttagttatttaggtgtagcggaagtagaccgtacccgaacggttcgtaaacccgtcgtttggtagtttcgtttagtactttcgtggtacggggtaccggtaaacggggtaactacggttaccggtacctacccggtttcttaacccgttccgaccgttaccccgacccgtaacccggaaacccgggttccccttacggttccccgggttccccttccccccgggtggccccgttcccttcggtaacccncggtaacggcccggtaccaccccggtaacgaacggaacc

SEQ ID NO: 393517 - DNA, 656 bp, Homo sapiens
  misc_feature: GZ8MTXP01D2WNE.38.28.C06.1.454.CMB.2.raw
  modified_base (279)..(279): a, c, t, g, unknown or other
  modified_base (397)..(397): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtggtccgccaggctccgaggggaaggggctgggagtcgggtctcagactaattaagtggggtaggggttanactacaactatactacgacgacggtaccggtccggggtcgggggtcctaccacctacgaccaacgaagaacgaaccaaccgtacgaaggacacctaactaatatactaactaaacaanacaccacacgacgtagacgaacgacgaacggacgacggtacgtagttagttagtagtgacgagacgacgtaccgtacgtacgtacgtacgttcgttgttcgttcgttacgttgtcgtacgggacgaacggtacgtacgtacgtcgtaccgtctctctccgtacctaccgaccgaaccgccgttccgtccgttcccgtcccgtccgttccgttcccgttccgtccgaccgaacgaccgaccgaccgtaaccgaacgaacg

SEQ ID NO: 393518 - DNA, 553 bp, Homo sapiens
  misc_feature: GZ8MTXP01D66LG.38.28.C06.1.454.CMB.2.raw
  modified_base (213)..(213): a, c, t, g, unknown or other
  modified_base (295)..(295): a, c, t, g, unknown or other
  modified_base (423)..(423): a, c, t, g, unknown or other
  modified_base (429)..(429): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaanagccaccctctcctgcagggccagtcagagtgttttcaacggctactagcctgtacagacaaaactgccaggctccagctcncatctatgtacatccgtcacgggccacgtggtactcccgaagaccaaggtttcagtggcctaggtgggtccgtggggacaggacttaccactcctcaccatcagcagactggagctagagtatttcgntagttnttagttctgtacagtactaagtactaacgtaacgaacgtaccgtacttacgttcggaacggtaacgggacaggttcgtaggaacgaaccgaacgacgtggtcgcgtacgaccactcgttcgtcg

SEQ ID NO: 393519 - DNA, 671 bp, Homo sapiens
  misc_feature: GZ8MTXP01ENEG5.38.28.C06.1.454.CMB.2.raw
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccgaggggaaggggctgggagtgggtctcagcaattaatggtaggggtgattcaccatattacgcagactccggtgggggccgttcaccatcaccagagacaactccaggagcacactatatctaacaaatgacacagcctgagaggtcgaggacacggccgtgtattattgtgcgagagactcccgaaacggtcgaccctaccgtttggtcgtctttttgacttttcgtagggttcggaacccgaaaggggactaaagttcgggtacctacccggttcttccttaccacgtccctacccaacccgaacgggcccctaacgttcccgggttcccttcccccgtcggcccgcccctcggccctccggagggacgccacccgtccgagacgccaccgacggcccggcccgttgggccgtcggtcccgttcgggtaccgaaacgggtacccttaaccgttcccgttacggttcgtaacgtccgtaacgtcgggacgggccgggggtccgttcgggaaccgg

SEQ ID NO: 393520 - DNA, 633 bp, Homo sapiens
  misc_feature: GZ8MTXP01DUVW7.38.28.C06.1.454.CMB.2.raw
  modified_base (311)..(311): a, c, t, g, unknown or other
  modified_base (571)..(571): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcttttctgtggctatttaaaggtgtccagtgtgaggtgcaggtgtcggagtcgtgggggagcgttggttcgacggcccggggggtccctgacgtactctccgtgtgcagtctcgtggtattaaccttagtgactatgctatgatcgtcggccnccgaggctccggagggggacgggtcgtgggaggtgggtctcgagtactaagttagtgggtagggtgtattacacctattaacgttacgcgtacggtacccgggtcccggggtacggggggtcccttaccgacgtaactcccgaaaccgagggaacaaccaaccgtaccgaagggacactaacacttaatactaactaaacaaaggtcacaacgacgccgtgagtaggaccgagaccggacgtcgtgttaattgcggtagngtagagttaccgttccgaacgggttcaacccgttgttcgggtctttcgtttgttccgtttgg

SEQ ID NO: 393521 - DNA, 582 bp, Homo sapiens
  misc_feature: GZ8MTXP01BWC5T.38.28.C06.1.454.CMB.2.raw
  modified_base (459)..(459): a, c, t, g, unknown or other
  modified_base (525)..(525): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcaggcccgggggtccctgagactctcctgtgcagtctctggattaaccttagtgactatgccatgatcgtgggtccgccaggctccgaggggaaggggctgggagtgggtctcgagcaagttaagtgggtacggggtgagttcgaccataaacttacgctagaccgtcccgggtggggggccgttcaccatccaccaggacgacaactcccgaagggacgccaacactanactacgtaacaaatcgacaacaggccctaggagagtacgaggacacgggccgttgtaattagttgngcgagagacttcccgaaggtcaccgtaaccgttggtacgttcttttggaacttttcg

SEQ ID NO: 393522 - DNA, 620 bp, Homo sapiens
  misc_feature: GZ8MTXP01ACYES.38.28.C06.1.454.CMB.2.raw
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcaccatattacgcagactccggtggggggccgttcaccatcaccagagacaactccaggancacactatatctaacaaatgccacagcctgagaagtcgaaggacacgggctgtattatgtgcgagagactcccgaaacggtgacccaccgtttgggtgtcctttttgatttttcgtggttacgggggacccaaagggggtaccaaagttcgggtaccacccggttcttccgttcacggtccctacccgaacccgaaacggggccccttaagttcccgggttccctttcccccccgtggggcccgccccttcggcctacccgaagggacgccacccgtccgaagaacg

SEQ ID NO: 393523 - DNA, 661 bp, Homo sapiens
  misc_feature: GZ8MTXP01BNUVP.38.28.C06.1.454.CMB.2.raw
  modified_base (217)..(217): a, c, t, g, unknown or other
  modified_base (275)..(275): a, c, t, g, unknown or other
  modified_base (331)..(331): a, c, t, g, unknown or other
  modified_base (599)..(599): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggtatttaacctttagtgactatgccatgatcgtgggtccnccaggctccgaggggaagggctggagtgggtctcagctaattaagtggggtaggggtnattcacatattacgcagactcggtgggggccgtcacatcacagagacactcaggancacactatatctaacaaatgacacagcctgagaacgtcggaagaccgacgggccgtagttaacttgtggtgcgaagaacgactacccgaagggtcgaacccctacgtttgggttcgttacttttgtaacttttctgggttcgggggacccgtaaagggggtaacctaaaggtttcggtacccgtacccggttcttccgttccgaacgtccccttacccgaacccggaaacggggccccttacggttcccgggttccctttcccccggngggttcccgttccccgttagcccaccgaacgggaccgcccgacccgttccgggaacgaaccg

SEQ ID NO: 393524 - DNA, 661 bp, Homo sapiens
  misc_feature: GZ8MTXP01A8XA5.38.28.C06.1.454.CMB.2.raw
  modified_base (217)..(217): a, c, t, g, unknown or other
  modified_base (274)..(274): a, c, t, g, unknown or other
  modified_base (298)..(298): a, c, t, g, unknown or other
  modified_base (331)..(331): a, c, t, g, unknown or other
  modified_base (629)..(629): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaacctttagtgactatgccatgatcgtggtccnccaggctccgaggggagggctggagtgggtctcagactaattaagtgggtaggggtnattcactatatacgcagcgtcggngggggcctcacatcacagacacactcgaggacncacactatatacaaacaaatcgaccaacagccgtagagaacgtaccgggaagaccacgggtcgttagttaagtttagtggtgacgagtacgtaccgtacccgtaacgggtgtaaccccttacggtttggtcgtttctttagtacgtttcgttacgggtacggggaacccgaaaggggtacctaaaggttccggtcccctaccggttcgttacttccgaaccgtccccttacccgaaaccggtaaccgggtccccttagttccccgggttccctccccgttgggccccttccggttccncccgacgaacggccgtaccacccgtcgaacgc

SEQ ID NO: 393525 - DNA, 643 bp, Homo sapiens
  misc_feature: GZ8MTXP01BVHKW.38.28.C06.1.454.CMB.2.raw
  modified_base (276)..(276): a, c, t, g, unknown or other
  modified_base (290)..(290): a, c, t, g, unknown or other
  modified_base (299)..(299): a, c, t, g, unknown or other
  modified_base (311)..(311): a, c, t, g, unknown or other
  modified_base (318)..(318): a, c, t, g, unknown or other
  modified_base (323)..(323): a, c, t, g, unknown or other
  modified_base (328)..(328): a, c, t, g, unknown or other
  modified_base (402)..(402): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagcctggggggtccctgagactctcctgtgcagtctctggatttaacctttagtgactatgccatgatcgtgggtccgccaggctccgaggggaaggggctggagtgggtctcagactaattaagtgggtaggggtnattcacatatacgnagcgtcggnggggcctcacancacaganacacncaggncacactatatactaacaaatgacccacagcctaggagtaacgtcgaacggacaccgggtcgttagtattagtgngacgagatacacccgaaggtctaaccctcgttggtcgtcttttagctttcgtggtacggggacgtaaaggggtacaaggttcggtacctaccgttcttccgttacgaccgtacccctaccgaacccggaaaccgggtccccttacggttccccggttccccttcccccgtggggcccccttcccgttcgccccgtaccgaacgggaccctaccgttaaccccggtccgaacgggtaacccg

SEQ ID NO: 393526 - DNA, 688 bp, Homo sapiens
  misc_feature: GZ8MTXP01C0HE4.38.28.C06.1.454.CMB.2.raw
  modified_base (275)..(275): a, c, t, g, unknown or other
  modified_base (314)..(314): a, c, t, g, unknown or other
  modified_base (323)..(323): a, c, t, g, unknown or other
  modified_base (336)..(336): a, c, t, g, unknown or other
  modified_base (664)..(664): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccgccaggctccgaggggaagggctggagtgggtctcagactaaattaagtgggtaggggtnattcacatatacgcagaccgtcggtgggggtcctcaccntcaccaganacaactcgaaggnacacactaatatctaaagaaatcgaccacgacgctagagaacgtacgaacggacaccgggtcgtagtattagttgagtcgaagagactacccgaaacggtcgaacccgttaccgtttgggtcgtttacttttagtacgtttcgtagggttacggggaacccgaaaggggtaacctaaaggttccggtaaccgtacccggttcttacccgttcgaaccggtcccctaacccgtaaacccggaaccggggtccccacggtttccccggttaccctttcccccccgggtcgggttccccgcccgttcgtaaccccgtaccggaacggaccncccgttaacccgtcgaacgtaacg

SEQ ID NO: 393527 - DNA, 714 bp, Homo sapiens
  misc_feature: GZ8MTXP01AGP58.38.28.C06.1.454.CMB.2.raw
  modified_base (331)..(331): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccgccaggctccgagggaaggggctggagtgggtctcagctaaattaagtgggtaggggtgattcacatatacgcagactcggtgggggccgttcaccatcaccagagacaactccaggancaacactatatctaacaaatgaccacagcctagagaagtcgaaggacacgggcgttgtattatgtgcgagagactaccccgaaacgggtcgacccgtaccgtttgggtcggttcttttagtacttttcgtgggttacgggggacccgtaaagggggtactaaacggttcgggttcccgtaaccccggttctttacccggttaccctaaccgggtcccccttaccccggaaacccggtaaaacccgggggtccccccttaaacggtttccccggggttccccttttccccccccggtgggggcccccttcccccggccgtccccgttacccgaaccggggttacccggtaccccaccccggttccgggaaccggtaaccccggg

SEQ ID NO: 393528 - DNA, 659 bp, Homo sapiens
  misc_feature: GZ8MTXP01BPOBM.38.28.C06.1.454.CMB.2.raw
  modified_base (282)..(282): a, c, t, g, unknown or other
  modified_base (296)..(296): a, c, t, g, unknown or other
  modified_base (333)..(333): a, c, t, g, unknown or other
  modified_base (608)..(608): a, c, t, g, unknown or other
  modified_base (638)..(638): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctccgaggggaaggggctgggaggtgggtctcgagactaaagttaagtggggtaggggtnattcacatatacgnagacgtcggtgggggcctcaccatcaccagacacacncaaggcacacatatactactaaacaaatgacccacgacgccgtaggagtaacggtacggaaggaccgacgggtccgttagttaatttagtggtaggacgaagacgtactaccccgaagggtcaacccgttacgtttgggtctttcgttttagtactttcgtcgggtacggggaacgtaaacggggtactaaaggttcggtaccctaccgttcttaccttcaaccgtccctacccgaaccgaacgggtcccttacgtcccggttccttcccccggngcccgttcccgttcggcctccgaacggacnccttacccgtcgaacgaaccg

SEQ ID NO: 393529 - DNA, 683 bp, Homo sapiens
  misc_feature: GZ8MTXP01EI9YK.38.28.C06.1.454.CMB.2.raw
  modified_base (260)..(260): a, c, t, g, unknown or other
  modified_base (270)..(270): a, c, t, g, unknown or other
  modified_base (667)..(667): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctgggagtggtctcagcaattagngggtagggtnattcacatatacgcagacgtccggtgggggccgttcaccatcaaccagacgacaactccgaggacgcaactactatatctaacaaatcgaccacagcctgagaacgtcgaacggacaccgggcgtagtatttagtgtacgacgtaagacgactaccccgaaacggggttcgaaaccccttaccggtttgggtacgtttaccgtttttgtaacgtttttcgtacgggttacgggggaacccgtaaaagggggtaacccttaaaggttccggttacccgaacccggtttccttaccgtttccaaccggtcccctacccgaaacccgtaaacggggccccttacggttcccggttcccctcccccggtggcccgttccccttggccctcgaacgggaccncccaccgtccgaagcg

SEQ ID NO: 393530 - DNA, 649 bp, Homo sapiens
  misc_feature: GZ8MTXP01BKGKS.38.28.C06.1.454.CMB.2.raw
  modified_base (275)..(275): a, c, t, g, unknown or other
  modified_base (443)..(443): a, c, t, g, unknown or other
  modified_base (629)..(629): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggattaacctttagtgactatgccatgatcgtgggtccgccaggcctccgaggggaaggggctgggagtgggtctcagcaattaagtgggtagggtnattcacatatacgcagactcggtgggggccgtcacatcaccagagacaactccgaaggacgcaacactatactctaacaaatgacccacagcctgagaagtcgaaggacacgggtctgtattagtgtgcgagagactaccccgaacggtcaacccgaccgtttgggtnttcgtttagtacttttcgtggtacgggggacgtaaaggggacctaacgttcgggtccctaacccggttccttaccgttaccgaaccgtcccccttacccgaacccggtaaaccggggccccttacgttcccgggttccccttcccccgtgggccccgttcccgttacgccctcccgaagggacccnccgttacccgtccgaacgcg

SEQ ID NO: 393531 - DNA, 626 bp, Homo sapiens
  misc_feature: GZ8MTXP01E2S41.38.28.C06.1.454.CMB.2.raw
  modified_base (284)..(284): a, c, t, g, unknown or other
  modified_base (368)..(368): a, c, t, g, unknown or other
  modified_base (592)..(592): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagcttggttcgaggcccgggggtcctgagactctcctgtgcagtctctggattaaccttagngactatgccatgatcgtgggtcccgccaggctccgaggggaagggctgggagtgggtctcgagcaaattaagtgggtaggggtnattccgaacctattaaacttacgctaaggaccgttcccggggtcggggggggtccccgtttacaaacccgtacgtacccaacccgaaggaacggaacccaaaccgtcccgaaagggacgaccaaacactaataactactaaaccaaagtcgacaacacgcctgagagtcggaggaccacggtccgtgtaattagttggcgacgagacgacgttcccgaacggtnaccctaacgttgggtcgttcttttggaactttcg

SEQ ID NO: 393532 - DNA, 678 bp, Homo sapiens
  misc_feature: GZ8MTXP01B8E9Y.38.28.C06.1.454.CMB.2.raw
  modified_base (214)..(214): a, c, t, g, unknown or other
  modified_base (269)..(269): a, c, t, g, unknown or other
  modified_base (334)..(334): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcagcaattaatgggtaggggtnattcacatatacgcagacgtccggtggggggcccgttcaccatcaccagagacaactccaggacncacactatatctaaacaaatcgacccacagccctggagaacgtcgaagggacacgggtccgttagtatttagttggcgcgagagactacccgaacggtcgaaccctaccgtttggttcgttcgtttttgacttttcgtgggttcgggggacccgtaaagggggtacctaaaggttcggtccctacccggtttccttcctttaccgaccgtccccttacccgaacccggtaaccggggccccttaacggttccccggttccccgtttccccccgtcgggccccgttcccccgttcggcccttcccgaacgggtccgacccgttacccgtcccggaagtaacccgg

SEQ ID NO: 393533 - DNA, 627 bp, Homo sapiens
  misc_feature: GZ8MTXP01EDRMS.38.28.C06.1.454.CMB.2.raw
  modified_base (327)..(327): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggaggcttgggttcgacggtccccggggggtccctggacgactctccgtgtgctagttctcgtaggatttaacctttagtgactatcgccatgatcgtcgggtccnccgaggcctccgagggggagggctgggagtgggtctcgagactaaagttaagtggggtacggggtgtattcaacctataaacgttacgcacgtaccgtccggggtcggggggtcccgttcaaccgtactaccaccgtaagaactaaccaacgtcccaagggacacaacactatactactaacaaatcgacacacgcctagagagtacgaggtacgacggtccgtgtaatttagttgtgacgagagaccgttcccgacggttcgaacctccgttggtcgttcgttttgttaacgttttcgg

SEQ ID NO: 393534 - DNA, 602 bp, Homo sapiens
  misc_feature: GZ8MTXP01ADXVW.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcaggcccgggggtcctgagactctcctgtgcagtctctggattaaccttgtgactatgccatgatcgtgggtccgcaggctccgaggggaagggctgggagtgggtctcgagctaaagttaagtggggtacggggtgatttcaacctataaacttaccggcaacggtaccgtccgggttgggggggcccgtttacaaccctatccaaccaggaacgaaccgaaaccgtcccgaagggacacaacactaactactactaacaaatgacacagcctgagacgtacgagtacgacggccgttggtaattagttgtgcgagacgacgttcccgaacggtcgaccctaacgtttggtcgttcttttggaattttcgg

SEQ ID NO: 393535 - DNA, 556 bp, Homo sapiens
  misc_feature: GZ8MTXP01ETJ7U.38.28.C06.1.454.CMB.2.raw
  modified_base (214)..(214): a, c, t, g, unknown or other
  modified_base (299)..(299): a, c, t, g, unknown or other
  modified_base (410)..(410): a, c, t, g, unknown or other
  modified_base (432)..(432): a, c, t, g, unknown or other
tcagtcgatcacgtcacgaccggtgctcgatttagagctcacgtattggggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaangccacctctcctgcagggccagtcagagttgttttcaacggtctacttagcctggtaccagacaaaactgcaggctccaggctcncatctatgtacatccgtcgacgggccacgtggtactcccagactacggttcagtggcaggtgggtctgggacagacttcactctcacatcagcagactggagctagaagtntttgctagtgtattctgtcagnagtatactaacacgtacctactacgtttggaaccgtaaggggacccaaggttccgtaagggaaccgaaaccgaaaacggttaacgttcgggtacggtctacggaccacctaacttcgttaaccg

SEQ ID NO: 393536 - DNA, 701 bp, Homo sapiens
  misc_feature: GZ8MTXP01B940G.38.28.C06.1.454.CMB.2.raw
  modified_base (271)..(271): a, c, t, g, unknown or other
  modified_base (474)..(474): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagtgggtaggggtnattcacatattacgcagactcggtgggggccgtcaccgatcaccagagacaactcaggagcacactatatctaacaaatcgaccacagcctagagacgtcgaaggaccacggggtccgtgtaatttacgtggtcgcgaagagactaccccgaaagggtcgaacccttaccgtttgggttacgttccttttagtaacttttcgnggttacgggggacccgtaaaagggggtacctaaaaggttcggggtaaccctaaccccggttctttaccgtttccgaaaccggtcccctttaaaccccgaacccgaaaaccgggggtccccttaaacggtttccccgggttcccctttaccccccgtgggaccccggttccccttggtccccttaccgaacggggaacccgtcccaacccgtcccggaaggaaccccg

SEQ ID NO: 393537 - DNA, 627 bp, Homo sapiens
  misc_feature: GZ8MTXP01A2NUI.38.28.C06.1.454.CMB.2.raw
  modified_base (390)..(390): a, c, t, g, unknown or other
  modified_base (592)..(592): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttattttaaaaggtgtccagtgtgaggtgcaggtgtcggagtcgtgggggaggcgttgggttcgacggccccggggggtcctgacgactctccgtgtgcagtctcgtggtactttaaccttagtgactatcgccatgatcgtcgggtccgccaggctccggagggggacgggcgtgggaggtcgggtctcgagtactaaagttagtggggtacgggtntagttacacctattaaacgtacgcgacggtaccggtccggggtcggggggtcccgttacaccgtacgtacaaccgagaacgactacctaccgaaggacacaacacttaatactactaacaatcgacacgacgcctaggacgacggtacggaacggtacgaccggcgttagtaattagttgtcgacgagacacgccgacggtnacccgtaattgggtcttctttcgttaacgtttcgg

SEQ ID NO: 393538 - DNA, 569 bp, Homo sapiens
  misc_feature: GZ8MTXP01BKUH3.38.28.C06.1.454.CMB.2.raw
  modified_base (211)..(211): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctcaggcaccctgtcttgtctccaggggaanagccacctctcctgcagggccagtcagagtgttttcaacggctacttagcctggtaccagacaaaactggaccaggcctcccaggcctcctcatctatcggtacatccgtcgacgggccacgtggtactccagacacgttcgagtggcgaggtgggtctgggacagacttcgactctacacatcagcagcgtggaggtctaggaagtagtttcgctagttgtattacgtgtactagactagtactaactacgaacgtaccgttactacgtttgggaacccgtaaggggacccgaagttcgtacggaacgttaaaccgaaacgacgtggcggtaacgtcgacaccgtaacttccgttcg

SEQ ID NO: 393539 - DNA, 711 bp, Homo sapiens
  misc_feature: GZ8MTXP01BNO1U.38.28.C06.1.454.CMB.2.raw
  modified_base (304)..(304): a, c, t, g, unknown or other
  modified_base (350)..(350): a, c, t, g, unknown or other
  modified_base (364)..(364): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcaggcccgggggtcctgagactctcctgtgcagtctctggattaaccttgtgactatgccatgatcgtggtccncaggctcgagggagggctgggagtgggtctcgagactaatttaagnggggttagggggtntacgtttccaacccgtattaaacgtttaacccggcgtaaacgggtacccgttcccgggggtcgggggggggtaccccgtttacaacccgtaattacccaacccgaaggaacgaacctaaaccttcccgaagggacgacctaaccgaaccttataactacttaaaccaaagttcggacaaccgacgaccctaggaagacgttaccggaacggtaaccgaccgggtcccgttaggtaactttagtttggtacggaccggaaaggacgaccgttaccccgaaaacggggttccgaaaccccgttcccggtttagggtcggttaccctttttgggttaactttttcccggg

SEQ ID NO: 393540 - DNA, 634 bp, Homo sapiens
  misc_feature: GZ8MTXP01BBPK9.38.28.C06.1.454.CMB.2.raw
  modified_base (340)..(340): a, c, t, g, unknown or other
  modified_base (512)..(512): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggaaggggctggagtgggtctcagctaattaatgggtaggggtgattcacatattacgcagacgtccggtggggggccgttcaccgatccaccgagacgacaactccaggancacactatatactaacaaatcgaccacagcctagagaagtcgaaggacacgggtccgtgtacttagttgtgcgtagaagactaccgaacggtcgaacccgtacgttggtcgtctttgtactttcgtggtaggggaccgtaaggggactaagtcggtaccaccgtctccttcncgtaccctccaacccgtaacgggccccttaacgttcccggttcccttcccccccgtggttccccgccccgttacggcccttcccgaacgggaccgcccgttaacccgtccggaacgaaccgg

SEQ ID NO: 393541 - DNA, 594 bp, Homo sapiens
  misc_feature: GZ8MTXP01DZWC2.38.28.C06.1.454.CMB.2.raw
  modified_base (214)..(214): a, c, t, g, unknown or other
  modified_base (376)..(376): a, c, t, g, unknown or other
  modified_base (384)..(384): a, c, t, g, unknown or other
  modified_base (549)..(549): a, c, t, g, unknown or other
  modified_base (556)..(556): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccncaggctccgagggagggctggagtgggtctcagcaattaatgggtaggggtgattcacatattacgcagactccggtggggggccgttcaccatcaccagagacaactccgaggacgcacactatatctaacaaatgccacagcctgagaagtcgaaggacncgggcgtntattatgtgcgagagactacccgaacggtcgaaccctcgtttggtcgttcttttgatttcgtaggttcggggcctaaaggggactaagtgggtcctacccgttcttacgttccacgtccccttaccgaccgaacgggtccccagttcccgggttccttcccccgngggcccnccccgttgcctccgaaggtcgccacccgtccgaagccg

SEQ ID NO: 393542 - DNA, 590 bp, Homo sapiens
  misc_feature: GZ8MTXP01D25WD.38.28.C06.1.454.CMB.2.raw
  modified_base (216)..(216): a, c, t, g, unknown or other
  modified_base (324)..(324): a, c, t, g, unknown or other
  modified_base (330)..(330): a, c, t, g, unknown or other
  modified_base (394)..(394): a, c, t, g, unknown or other
  modified_base (401)..(401): a, c, t, g, unknown or other
  modified_base (549)..(549): a, c, t, g, unknown or other
tcagtcgatcacgtcacgaccggtgctcgatttagagctcacgtattgggtttgggctgagctggctttttcttgtggctatttttaaaaggtgtccagtgtgaggtgcaggtgtcggagtctgggggaggcttggttcagcctggggggtccctgagactctcctgtgtagtctctggatttaacctttagtgactatgccatgatctgggtccncaggctcgagggaaggggctggagtggtctcagcaattaagtgggtaggggtgattcacatatacgcagacgtcggtgggggtccgttcaccatcaccagagacaacncaggancacactatatactaacaaatgacacagctgagagtacgaggcacgggcgtagttattagttggngcgaganactaccccgaaggtcgaccctacgttgggtagtcttttgatttcgtagttcggaccggaaaggggtactaagtcggtaccaccgttctcttaccacgtccctaccaccgaacgggccctacgttccggttcccttcccccgtggcccncccgttgccctccgaggcgccacccgacgaacgaacgcccg

SEQ ID NO: 393543 - DNA, 667 bp, Homo sapiens
  misc_feature: GZ8MTXP01ATUOL.38.28.C06.1.454.CMB.2.raw
  modified_base (294)..(294): a, c, t, g, unknown or other
  modified_base (320)..(320): a, c, t, g, unknown or other
  modified_base (359)..(359): a, c, t, g, unknown or other
  modified_base (383)..(383): a, c, t, g, unknown or other
  modified_base (468)..(468): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagtcgttggttcgacggcccggggggtcctggacgactctccgtgtgcagttctcgtggtattaaccttagngactatgaccatgactcgtgggtccnccgaggtctccggagggggacgggctgggagtgggtctnagctaaagttagtggggtagggtntacttcgactataaacgttcgcgagtacccgtcgggtcggggggtccgttcaaccgtatccaaaccgaggtaacgaactaaaccnccgaagggacacaacctaactaattaactactaaaccgaaatcgaccaacgacggacctggaacgtacgccgggaaaggtaccgacggggttccaggtttaacgttagtttggcgcggaacgtaacgaccgttccccggaaaccggtgtaaacccttcccggtttaggtcccggtttaatttttcgaaccgtttttggg

SEQ ID NO: 393544 - DNA, 567 bp, Homo sapiens
  misc_feature: GZ8MTXP01EB5VX.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcaacttctcttcctcctgctactctggctctcagattccaccggagagattgtgttgacgcagtctccaggcaccctgtctttgtctcgagggaancgccacctctcctgcagggccagtcagtagttgtttcaacggtctacttagcctggtaaccagacaaaaacctggaccaggcctcccgaggcctcctcatctatcggtacagtccgtcgacgggccacgtggtactccgagacgtacggttcagtggcgtaggtgggtctggggacagtacttcactctcacatcagcagacgtagggacgtctagtaagtatttgctagttgtattacgtgtacaggctaagtactactaacaacgtacctactacgtttggaaccgtaagggacccaaggcgtaggaacaaccgaaacgttaacgtggtaggctggcttactaacttcgttcg

SEQ ID NO: 393545 - DNA, 716 bp, Homo sapiens
  misc_feature: GZ8MTXP01BZP8F.38.28.C06.1.454.CMB.2.raw
  modified_base (275)..(275): a, c, t, g, unknown or other
  modified_base (507)..(507): a, c, t, g, unknown or other
  modified_base (643)..(643): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatctcggggtccgccaggctccgaggggaaggggctgggagtgggtctcagctaattagtgggtaggggtnattcacatatacgcaggaccgtccgggtggggggccgtcaccatcacagacacactccgaggacgcacactatactactaaacaaatcgacccacagcctaggaagaacggtcgaagggaccaccggggtccgttagttaatttagttggtaggaccgaaggacgtaacgtaccccgtaaacggggtctaaccccgtaacgttttgggtcgttacgttttgtacgttttcgnggttacggggaacccggtaaaggggacctaaggttccgggtaccctacccggttcttacccgttcaccggccccttaaccccgaaccccgggtaacgggtcccccttacggttccccggttccccgtttcccccgnggggttcccccgttacccgttcgcccttacccggaacgggtaccgacccttcccgtaacccgaaggaacccgg

SEQ ID NO: 393546 - DNA, 578 bp, Homo sapiens
  misc_feature: GZ8MTXP01AIZV2.38.28.C06.1.454.CMB.2.raw
  modified_base (285)..(285): a, c, t, g, unknown or other
  modified_base (508)..(508): a, c, t, g, unknown or other
  modified_base (530)..(530): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgtgctcaactgtcttgtccaccttgctgagctggctttttcttgtggctattttaaaaggtgtccagtgtgaggtgcaggtgtcggagtcgtgggggaggcttggttcagccgtggggggtccctgagactctcctgtgcagtctctggattaacctttgngactatgccatgatcgtgggtccgccgaggctccgaggggaggggctggaggtgggtctcgagctaaagttagtcggggtaggggtgtagttcgactaattacttaacgctaggtacgtccggggtcggggggtcccgttcacccgatccgaaccgagacgacaacgtccgaggacacaacactaatactactaacaaatgacacagctgagagcgaggtacncgggtctgtattgtgttgcganacgcgttacccgaagggtcgaaccctcgttgggacttcgtttgtaacg

SEQ ID NO: 393547 - DNA, 538 bp, Homo sapiens
  misc_feature: GZ8MTXP01DQD29.38.28.C06.1.454.CMB.2.raw
  modified_base (214)..(214): a, c, t, g, unknown or other
  modified_base (321)..(321): a, c, t, g, unknown or other
  modified_base (414)..(414): a, c, t, g, unknown or other
  modified_base (431)..(431): a, c, t, g, unknown or other
  modified_base (435)..(435): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaangccacctctcctgcagggccagtcagagtgttttacaacggctacttagcctggtaccagacaaaaactggccaggctccaggctcctcatctatggtacatccgtnacgggccactggtactcccagacaggttcagtgcagtgggtctgggacagacttcactctcaccatcagcagactggagctagaagtatttgnaagtgtaattactgtanaganatatactaacaacgtactactacgttgtaacgaacgggacgaacgacgtacggaacgaaacgaaacgaacgtaaggtaggtcgtcgacgactaacgttcgtcg

SEQ ID NO: 393548 - DNA, 686 bp, Homo sapiens
  misc_feature: GZ8MTXP01CKI85.38.28.C06.1.454.CMB.2.raw
  modified_base (253)..(253): a, c, t, g, unknown or other
  modified_base (279)..(279): a, c, t, g, unknown or other
  modified_base (361)..(361): a, c, t, g, unknown or other
  modified_base (643)..(643): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttgggttcagccgtggggggtccctgagactctcctgtgcagtctctggatttaacctttagtgactatgccatgatcgtgggtccgccaggctccgaggggaagggctggagtgggtctnagactaaagttaagtgggtaggggtnattcactatattacgcaggaccgtccgggtcggggggtcccgttcaccgtataccaccgagaacgacaacctaccgaggacncaactaactatactactaaacgaaatcgaccaacgcgccgtagacggtaacgtaccgggaacgggacctaaccggggtccttaggtaatttacggttgacggacgtaagacggtacctaccccggaacgggttacaacccgtttaaccgttggttacgtttccgtttttagtacgttttcgtagggtacggggaaccgtaaaggggaactaggtccggtcctaccgtcttacctcacgtccctaccgaccgaacggtcccttacgtccggttcccttcccgngcccgcccttagccctcgaacggccaccgacccgtcgaacgcg

SEQ ID NO: 393549 - DNA, 734 bp, Homo sapiens
  misc_feature: GZ8MTXP01AQ38K.38.28.C06.1.454.CMB.2.raw
  modified_base (277)..(277): a, c, t, g, unknown or other
  modified_base (364)..(364): a, c, t, g, unknown or other
tcagtcgatcacgtcacgaccggtgctcgatttagagctcacgtattgggtttgggctgagctggctttttcttgtggctattttaaaaggtctccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctgggagtgggtctcagctaattaagtgggtaagggggttnactcactatagtacgcacggtaccgtcgggtcgggggtcctcaccatccacgagacgacaacgcgaggacacactatatactacaanaatcgaccacgacgccgtaggacgtaacgtacggaacggaccgtaccgggtcgttagttaatttaggttcgacgacgaagtaacgtaaccgtaacccggaaacggttctaacccgttaccgtttggtacgtttacgtttacgttacgtttcgtcggtacggggtaaccggaaacgggtactaacggttccggttaccgtacccgttacttaccgttaccgtaccgtaccccgtacccgaacccggtaaccgggtccccttacccggttccccggttccccgtttcccccgggtcggttaccccgttccccgttaccggaaccccgtaccggaaccggacccgtcccgttaccccgtccggaacgaacccg

SEQ ID NO: 393550 - DNA, 771 bp, Homo sapiens
  misc_feature: GZ8MTXP01CQMK6.38.28.C06.1.454.CMB.2.raw
  modified_base (383)..(383): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttggctgagctggtcttttttcttgtggcttaattttaaaaggtgtccagtgtgaggtgcaggtgtcggagtcgtgggggagcgttgggttcacgggcccgggggtccctgagactctcctgtgcagtctcgtggtaatttaaccgtttagtgactatcgccatgatcgtcggtccgcaggctccggagggagggcgtggaggtcgggtctcgagtactaaagttagtgggttaggggtntagttacaaccctaattaaacgttacggcgtaacgggtaaccgttccgggggtccggggggtacccgttaccgacccgtaactacccgaaccgaacggaacggaaccaaacccgttacccgaaagggtacgaccaaacctaaacttaactaacttacctaaacaaaacggttcgaaacccaacgaaccggtacccgtaaggaacgtacggtaaaccggaccgggtaaccggtaacccgggttaccgtttaggttaaagttttaaggttgggtacgaccggtaaaggtaaccggttaacccgtttaccccggaaacgggttaacccgaaaccccgtttcccggtttgggttacgtttacccgtttttaaggttaacgtttttcccgggg

SEQ ID NO: 393551 - DNA, 640 bp, Homo sapiens
  misc_feature: GZ8MTXP01DX7DC.38.28.C06.1.454.CMB.2.raw
  modified_base (220)..(220): a, c, t, g, unknown or other
  modified_base (278)..(278): a, c, t, g, unknown or other
  modified_base (306)..(306): a, c, t, g, unknown or other
  modified_base (363)..(363): a, c, t, g, unknown or other
  modified_base (486)..(486): a, c, t, g, unknown or other
  modified_base (592)..(592): a, c, t, g, unknown or other
  modified_base (598)..(598): a, c, t, g, unknown or other
  modified_base (618)..(618): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtggggggaggcttggttcagccgtggggggtccctgagactctcctgtgcagtctctggatttaacctttagtgactatgccatgatcgtcgggtccnccaggctccgaggggaagggctggagtgggtctcagactaattaagtgggtaggggtnattcaacatatacgcaggacgtccgggngggggtccttacaccatccaaccagacaccaactcaaggcacacatagtatactaanaaatcgacccacacgtcctaggagaacgtcgaaggacaccgggtcgttagttattagttggagcgaagacgactacccgaaacggtacacccgtacgtttgggtcttcgttttagattttcgnggttacgggggaaccgtaaaggggtacctaaaggttcggtacctaccgttcttacctcgacgtccctaccgacggaacggtcccttagtcccggttccttccccgnggcccnccgttgccctacgaacggcncccgttaccgtcgaaggaaccg

SEQ ID NO: 393552 - DNA, 816 bp, Homo sapiens
  misc_feature: GZ8MTXP01DE2TR.38.28.C06.1.454.CMB.2.raw
  modified_base (199)..(199): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatgggtaggggtnattcaccatattacgcagactccggtgggggccgttcaccatcaccagagacaactccaggagcaacactatatactaacaaatgcacagcctgagagtcgaggacacggcctgtattattgtgcgagagactacccgaacggtcgacctaccgttggtgtcttttgtacttttcgtagggttcggccgaaaggggtaacctaaagttcgggtaccctaacccggttcttcccgtttacgacgtacccccgttacccgaaacccggtaaaccggggtccccctaacggtttccccggggtttccccctttccccccccggtggggcccccgtcccccgttcgggtccccttaccccgggggaacggggtacccgtaccccgaaccccgggttaccccggaacgaccggaccccgaaaccggtccggggccccggggtcccccggtcgggggtacccttccggggtccccggttaccgggggtaacccgaaaaccgggggttaacccctttaacccggtttaccccgttaccgggtttacgggaaacccgtttcccgggaaaccggttcgggggaaccggggttcccggggggttaaccgttcgggggaaaccccggg

SEQ ID NO: 393553 - DNA, 669 bp, Homo sapiens
  misc_feature: GZ8MTXP01EFNYL.38.28.C06.1.454.CMB.2.raw
  modified_base (287)..(287): a, c, t, g, unknown or other
  modified_base (312)..(312): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttcttgtggctattttaaaaggtgtccagtgtgaggtgcaggtgtcggagtcgtgggggaggcttgggttcaggcccggggggtcctgagactctcctgtgcagtctctggattaacctttagngactatgccatgatcgtgggtcccncgaggctccgaggggaaggggctgggagtgggtctcgagactaattaagtggtacggggtgatttcaccattaaagttaccgcgagtaccgtccgggtcggggggtccgttacaccgatccaaccgagacgacaactacccgaaggacgcaacactaatactactaaacaaacttcgaccaacacgtcccgtagacgtaaggtaccggaaggtaccgaaccgggtcccgttagggttaaactttaagttcggttacggacgtaaggaacgaccgtttccccggaaaacgggttccgggtaaccccttaacccggtttcgggtacgtttcgttttttaacggttaagttttttccggg

SEQ ID NO: 393554 - DNA, 670 bp, Homo sapiens
  misc_feature: GZ8MTXP01BF14Q.38.28.C06.1.454.CMB.2.raw
  modified_base (308)..(308): a, c, t, g, unknown or other
  modified_base (382)..(382): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggagcttggttcaggcccgggggtcctgagctctctgtgcagtctctaggtattaaccttagtgactatgcatgatcgtcgggtccncgaggcctaccggagggggaacggggtctggggagtcggggtctcgagacgtaaattaggtggggttaggggtntatttccaaccgtaattaacgttaaccgcgtaggacccgttcccgggggtcgggggggtccccttacaccgtactaccaaccgaacgaacgaaccaacctcccgaagggacgaccaaacctaactaacttactaactaaacaaacttcgaccaaacaccgaccgtagaacgtacggacccggaaggaccggtaacgggtccgttagttaattagttggtggacgaagtacgaccgttacccgacggtcgaacccgttcgttgggtcgttcgtttggttaacttttcgg

SEQ ID NO: 393555 - DNA, 656 bp, Homo sapiens
  misc_feature: GZ8MTXP01CLNGU.38.28.C06.1.454.CMB.2.raw
  modified_base (287)..(287): a, c, t, g, unknown or other
  modified_base (302)..(302): a, c, t, g, unknown or other
  modified_base (351)..(351): a, c, t, g, unknown or other
  modified_base (614)..(614): a, c, t, g, unknown or other
  modified_base (640)..(640): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggtaatttaacctttagtgactatgccatgatcgtcgggtccgccagggcctccggaaggggaaggggctgggaggtgggtctcagactaaagttaagtggggtaggggtnattcactatatacgnagacgtcgggtgggggccgtcaccatcaccagacaacactccgaggacncaacaactatactactaaacaaatcgaccacacgcctaggaggaacgtcgaacggacgacgggtccgttagttacttagtggtacgacgtagaacgactacccgaacggtcgacccttacgttggtcgttcttttgtactttcgtaggttcgggggaaccgtaaaggggtactaaggttcggtaccctaccggttcttccctacgaccgtccctaacccgaaccggaaaccgggtcccttacgttcccggttcccttccccgnggccccgttccgttcgctccgaagcnccaccgtcgaacgccg

SEQ ID NO: 393556 - DNA, 630 bp, Homo sapiens
  misc_feature: GZ8MTXP01BZZZT.38.28.C06.1.454.CMB.2.raw
  modified_base (608)..(608): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctagggggaggcttggttcagcctggggggtccctgagactctcctgtgcagtctctggattaacctttagtgactatgccatgatctgggtccgccaggctccgagggaaggggctggagtgggtctcagcaattaatgggtaggggtgattcacatattacgcagactcggtggggggccgttcaccatcaccagacgacaactccaggagcacactatatctaacaaatcgccacagcctgagaagtcgaaggacacgggccgtgtattatgtgcgagagactcccgaaacggtgaacccgtaccgtttggtcgtctttttgacttttcgtgggttacgggggaccctaaagggggtacctaagttcgggtacctacccggttcttacctttcgacgtcccctaccgaacccgaaacggggtccccagttccgggttcccttccccccggtggccccgttcccttcggcccttccgaacgggacncccgaccctccggaagaaccgg

SEQ ID NO: 393557 - DNA, 648 bp, Homo sapiens
  misc_feature: GZ8MTXP01BZR5G.38.28.C06.1.454.CMB.2.raw
  modified_base (313)..(313): a, c, t, g, unknown or other
  modified_base (373)..(373): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgagtgcaggtgtcggagtcgtgggggaggcttggttcgaggcccgggggtcctgagactctcctgtgcagtctctggtaactttaaccttagtgactatgccatgatcgtggtcccncgaggctcggagggaggggctgggagtgggtctcgagactaaagttaagtgggtagggtntattcacctataacttacgcgtagaccgtcggggtcgggggtcccgttacgaccactacaccgaaggaacgaaccaaccgtcgaagggacaccaactactaataactactaaaccaaagttcgaccaacgcgtaccgtaggaggtacgtaccgggaacggaaccgtacggtccgttagttaactttagttcggaggacgtaaggaacgttaccgttcccggaaacggttgtaaccccgttcggtttaggtgtttacgttttcgttaacgtttcgg

SEQ ID NO: 393558 - DNA, 617 bp, Homo sapiens
  misc_feature: GZ8MTXP01BIH2M.38.28.C06.1.454.CMB.2.raw
  modified_base (335)..(335): a, c, t, g, unknown or other
  modified_base (597)..(597): a, c, t, g, unknown or other
tcagtcgatcacgtcacgaccggtgctcgatttagagctcacgtattgggtttgggctgagctggctttttcttgtggctatttttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagcaattaatgggtagggtgattcacatattacgcagacgtccggtgggggccgttcaccatcaccagacgacaactcgaggancaacactatatctaacaaatcgaccacagcctagagaacgtcggaaggaccgaccgggccgttagttaatttagttgtagcgaagagacgtcccgaaacgggtcgtaaccccgtacgtttgggtgtttccgttttggtaacttttccgtagggtccggggtaacgaaaggggtactaagttcgggctacccggtctacttcacgcctacccacgaacgggcccttagtccggttcctccccgtgccgccccttgcctaccgnggacgtcacccgtgcgaacg

SEQ ID NO: 393559 - DNA, 649 bp, Homo sapiens
  misc_feature: GZ8MTXP01BC8O7.38.28.C06.1.454.CMB.2.raw
  modified_base (542)..(542): a, c, t, g, unknown or other
  modified_base (581)..(581): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcgttggttcgaggcccgggggtcctgagctctcctgtgcagtctctggtattaaccttagtgactatgccatgatcgtcgggtcccgccgaggcctaccggagggggaagggggcgtagggtaggtgggtctacgagtactaaagttaagtgggtagggtgtacttcacctataaacttaccgctacggaccgtccggggtcggggggtcccgttacgacctactacccgaacgaacggaacgaaccaaccgtacccgaaagggacaccaactaacttaataactactaaaccaaagtcacgaacgcgaccgtgaacgnggtacggacgtaccgacggtccgtgtaatttgttgtcgngaacgcttaaccgttcccgaaggtccgaaccgtccgtttgggtcttcgttttaacgttaacgtttcgg

SEQ ID NO: 393560 - DNA, 690 bp, Homo sapiens
  misc_feature: GZ8MTXP01A7OQD.38.28.C06.1.454.CMB.2.raw
  modified_base (316)..(316): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggaggtcgttggttcgacggcccgggggtccctgagactctcctgtgcagtctcgtggacttaaccttagtgactatgccatgatcgtcggtccncaggctccggaggggaacgggcgtgggaggtgggtctcgagtactaaagttaagtgggtaggggtatattacaacctattaacgttacgcgtacggtaccgtccggggtcggggggtccgtttccaccgtaatacccgaaccgaagaacgaaccaacgtacccgaaggacacaacgtaactaataactactaaacaaagtcgaaccacgacgtccgtaggacgtacggtaaccggacgggtaaccgtaccgggtaccgttaggttaatttaagttggtaggaccggtaggaacgttaccgttaccccggttaaaggggtccctaacccggttaaccggttggtcgtttaccgttttaaggttaaccgttttggg

SEQ ID NO: 393561 - DNA, 667 bp, Homo sapiens
  misc_feature: GZ8MTXP01CVOBD.38.28.C06.1.454.CMB.2.raw
  modified_base (282)..(282): a, c, t, g, unknown or other
  modified_base (352)..(352): a, c, t, g, unknown or other
  modified_base (428)..(428): a, c, t, g, unknown or other
  modified_base (488)..(488): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtaatttaacctttagtgactatgccatgatcgtgggtccgccaggctccgaggggaagggctgggaggtgggtctcagctaaagttaagtggggtaggggtnattcactatattacgcagacgtccgggtgggggccgttcaccatccaaccagacgaacaactccgaggancaacactatatactaaacaaatgacccacagccgtagagacgtacgaaggaccgaccgggtcgttatattagttgngacgagacgactacccgaacggtcgaacctacgtttggtcgttcgttttcgtattttcgnggttacggggaccgtaaaggggtaccaagttcggtaccctaccgttcttccttcgaccgtccctacccgaaccggaaccgggcccttacggttcccggttcccgtttcccccgtacggccccgttacccttcggcccctaccggaacggaccgaccaccccgtaaccggaacgtaaccg

SEQ ID NO: 393562 - DNA, 626 bp, Homo sapiens
  misc_feature: GZ8MTXP01A079H.38.28.C06.1.454.CMB.2.raw
  modified_base (177)..(177): a, c, t, g, unknown or other
  modified_base (572)..(572): a, c, t, g, unknown or other
  modified_base (600)..(600): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgnagtctccaggcacctgtctttgtctccgaggggaaagagccacctctcctgcgacgggccagtcagtagttgttttcaacggtctacgttagcctggtaccagacaaaaaccgtggaccaggcctcccgaggcctcctcactctagtcggtacactcccggtcgacgggccacgtggtactcccgagacgtacggttaccaggttcggaccgtagggtcggggttactgggggactaaggtaccttaccgaacttctacaacctactacgagacgaacggaccgtagggaggtacgtagtaagtatttgacgtagttagttacgttacgtgtacgagtacgtaatactaacgtaacaacgtaccgtactacgtttcggaaccgagggttacacgngtaggaacaccgaaacgttacgtaaggngtcgtcgaccacctaagttcttaacg

SEQ ID NO: 393563 - DNA, 659 bp, Homo sapiens
  misc_feature: GZ8MTXP01BLKRO.38.28.C06.1.454.CMB.2.raw
  modified_base (275)..(275): a, c, t, g, unknown or other
  modified_base (337)..(337): a, c, t, g, unknown or other
  modified_base (639)..(639): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctccgaggggaagggctggagtgggtctcagactaattaagtgggtaggggtnattcacatatacgcagacgtcggtgggggtccgtcaccatcaccagagacaactccaaggancaacactatatactaacaaatgacccacagcctaggaacgaacgtacggaaggaccacgggtcctagttaatttagtggtcgacgaagagacgtacccgaacgggtcgaacccctacgtttggtgttcgttttagacttttcgtgggttcggggaaccggtaaaggggtaactaacggttcggtacctacccgttctccttacaccggtcccctaccgaaccggaaccgggtccccttacggttccccggttcccgttccccccgtggccccgttcccgttcgccctccgaaggggtacccncccgacccgtccgaaggccg

SEQ ID NO: 393564 - DNA, 568 bp, Homo sapiens
  misc_feature: GZ8MTXP01DECS9.38.28.C06.1.454.CMB.2.raw
  modified_base (215)..(215): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaaanagcccaccctctcctgcagggccagtcagtagtgttttacaacggctacttacgcctggtaccagacaaaactggaccaggctccagctcctcatctatggtacatccgtcgacgggccacgtggtactccagacgtacggttcgagtggcaggtgggtctgggacagtacttcactctacacatcagcagactgggagctagaagtgtttgatagtagttattacgtgtacagctaagtactaactaacaacgtaccgttacgtaccgtttggaaccgtaaggggacctaagcgtaacggaacgaaaccgaaacgaacgtggtaggccttggaccacctaacttcgttaacg

SEQ ID NO: 393565 - DNA, 586 bp, Homo sapiens
  misc_feature: GZ8MTXP01BP48S.38.28.C06.1.454.CMB.2.raw
  modified_base (315)..(315): a, c, t, g, unknown or other
  modified_base (380)..(380): a, c, t, g, unknown or other
  modified_base (572)..(572): a, c, t, g, unknown or other
  modified_base (580)..(580): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcgttggttcgaggcccgggggtccctggacgactctcctgtgcagtctcgtggtattaaccttagtgactatgccatgatcgtgggtcccnccgaggctccgagggggaagggctgggaggtgggtctacgagactaagttaagtggggtagggtnattcaacctataaacttacgcgacgtaccgttccgggtcggggggtcccgttacaccgatccacaggacgaccaactccgaaggacgacacactatactactaaacaatcacaacacgtccagagacgtacgagtacgacggtcgtgtaattagttggtgagagaagcgttccgacgtcgacctcgttggtnttctttgntttcgg

SEQ ID NO: 393566 - DNA, 707 bp, Homo sapiens
  misc_feature: GZ8MTXP01AWSFU.38.28.C06.1.454.CMB.2.raw
  modified_base (275)..(275): a, c, t, g, unknown or other
  modified_base (344)..(344): a, c, t, g, unknown or other
  modified_base (639)..(639): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggaagggctgggagtgggtctcagactaattaagtggggtaggggtnacttcacatattacgcagacgtccgggtgggggccgttcaccatcaaccagacgacaactccgaggacncacataatatactaacaaatcgaccaacgagccgtaggaaggtaacgtacggaacggtaaccgtaccgggtaccgttaggtaatttaggtggtcggacgaagaacgtacctacccggaacggtcgtaacccgtacgtttggggtcttcgtttagtacttttcggtaggttacggggacgtaaaggggtacctaagttcgggtaccctaccggttcttacctaccgaccggtacccctaacccgaacccggtaaacggggccccttaggtttcccccggttcccgtttcccccggngggttccccttcccgttcggcccctccgggaacgggaccccgcccgttacccggtccggaacgaaccg

SEQ ID NO: 393567 - DNA, 626 bp, Homo sapiens
  misc_feature: GZ8MTXP01DA95A.38.28.C06.1.454.CMB.2.raw
  modified_base (277)..(277): a, c, t, g, unknown or other
  modified_base (423)..(423): a, c, t, g, unknown or other
  modified_base (478)..(478): a, c, t, g, unknown or other
  modified_base (581)..(581): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtgggtccgccaggctccgaggggaaggggctgggagtgggtctcagactaaattaagtgggtaggggtnattcaacatatacgcagaccgtcgggtgggggccgttcaccatccaaccagacgacaacgtcgaaggacacacaactagtactactaaacaaatcgacccacagcctagagaacgtcggaaggacaccgggcttagtatttatggngcgagagacacccgaaaggtcgaccttacgttgggtacttcgtttagattttcgnggtacggggtaacccgaaaggggaacctaagttcggtaccaccgttctacttcgacgtcccacccgaacgaacggcccttaggtcccggttccttcccccggngcccgcccttgaaccctcgaacggcgaccacccgtcgaacgaacg

SEQ ID NO: 393568 - DNA, 674 bp, Homo sapiens
  misc_feature: GZ8MTXP01DMX49.38.28.C06.1.454.CMB.2.raw
  modified_base (376)..(376): a, c, t, g, unknown or other
tcagtcgatcacgtcacgaccggtgctcgatttagagctcacgtattgggtttgggggagagctctggagaagagctgctcagttaggacccagagggaaccatggaaaccccagcgcagcttctcttcctcctgctactctggctccagattccaccggagagattgtgttgacgcagtctccaggccaccctgtctttgtctaccgaaggggaaagagcccaccctctcctgcgagggccagtcagtagttgtttacaacggtctacttacgccgtggtacagacaaaactcggaccagcctccgaggctcctcatctatcggactactccgtcgacggccacgtggtactccagactacggttcgaggtcggngtaggtcgggtacgtggggacacggtacttcgaactctacaccgatacgaagcgagacgtagggacgtacgtagtaaagtagtttcggataagggttattaacgggttacgttaggtactaacggactaaaggttaactaccgttaaaacgaacgtaaccccggtttaacttaccggttttacggaaccccgggtaaggggttaaacccgtaaacggccggttaaaccgggtaacgttaaaaccccgaaacggttaaccgtggtacggtccgtacgcaacctaacgttccggtttaag

SEQ ID NO: 393569 - DNA, 603 bp, Homo sapiens
  misc_feature: GZ8MTXP01BLMRT.38.28.C06.1.454.CMB.2.raw
  modified_base (289)..(289): a, c, t, g, unknown or other
  modified_base (312)..(312): a, c, t, g, unknown or other
  modified_base (375)..(375): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctatttaaaaggtgtcagtgtgaggtgcaggtgtcggagtcgtgggggagtcgttggttcgacggccccggggggtcctgacgtactctcctgtgctagtctgtggtattaaccttagnactatcgcatgatcgtcggtccncgaggcctccggagggggagggctggggagtgggtctgagactaaagttagtgggtacgggtntatcaccataactacgcagacccgtcgggtcgggggaccgttcacgtcacacgagacgaacaacgccgaaggacacactaactataatactaacggaaacgcacacgacgacgaggacgacggtacggacgtaccggtacggtcgttagttaagttaggttgtacgacgtaagtacgaccgttacccgacggtccgtaccttcggttgtcgtttcgttcgttcgtcgg
